United States Patent 11,466,288 (METHODS FOR REPRODUCING PLANTS ASEXUALLY AND COMPOSITIONS THEREOF) - sequence listing, part 2

SEQ ID NO: 677 - DNA, 13240 bp, Zea mays
cggatccatgaaggggccgacggaggaagaaggagcagctgacggtgggctagggaggggactggccggtggcaggtttggcgcagacctgcttggcgacgacggagggaaggggagggagagggcggtggttgcaggagcgtcagcgacgggggagggagagaccacggctagggacgtcgtcggctggggaaagggcggccgacgatggggacactagctgcggctgctggtgcagcggttggggtggggagggaggggagagaaaagtggaaaactaacctaactctatatctcgtgggaaactctaaccctaaccaaggttgtgagttgtattaatagactcagtttgttgggcctggcccattacacataggtgtaaatgtaattacaagagattaatcctaaaattttaaatgggtactctaacacctaacagtttatacatgcaactgttgaccataagtgtgttttttcaatataaacaacgactctatatcctatcggcccacaaattaacttttactagcaatgatagatggtatatagatagctcataacagttacccagcacgatagtaggagaatagagaaaagatcgctatacttggctaggaatgtaaaccactgctacccgtctaccatattcaagtgaaactcttgactgtgtgcccttcgaatgatagtgtttatctgccaccattgtactccctctgctgcaccttctagcttcgttctaaatcaaacttctctaatattaactaagtttatagaaaaaatacaccaacatctaaaacattaaattatttcatgacatccaccatgaaatatgttttgatggtacctttatttagtattgtatatgctaatatacttttgtacaaatttgatctgagatagagaagtttgacttagacgaaactaacattttggaatagagagagtgtggatgtgttagtgtgtaaatatattaactagtcctaaactctaatgagttgtttatggattattataatctagattatataatccacttaataatctatgttgtttgtttgtctcttaacttatttaagctagattatataatatagagggtaaacaaacatgggagatataatgcaagctaaagctaataggagattagaagcaaccaatcagatttcaagtgaaaggatgccgagctgctcgttattatactaacaaaagcatcagttctgttaagtaaaactaaacacaagaatggagaggttcgtcacgacggtattaggctgaggcgaaatcatgtgccaacaaacgcatttcgcgttcatttcgcaggcacgtgccatgtaacattatgggtccacgtgccagccgctcatcagcgccagcgggaacccgtccgtacctggcacctccggcctctggagtccgccttcgcaacggtaacggtagcggccgcctgccccccgccgtctcccggggcccagccaacgaacgaacacaggccacggccacggcgccacccacacccaccgcctcacgcacttcgccttctcgcccagttcagctcctctctcccccttccgccgtgtctcgctcctcctggctatgccgatttataaacccccaccgcgccatgcgctccccaccgccacagccactccacccgcaccgaaccaatggcggacgccgccacctccgaggatgccgacctgccgcccccacctccgccggcgcagctcccgcctcctcgccgcccgcacaagcggcttcagccgcgggggtactgatcgactctgatctcgcgctgcgcagccgtgtcggggcctgggcttatgtgggttatctcgcttgcaggtaccaggtggaggtgttcgctgcggcgctgcgcgggaacaccatcgcggtgctagacactggctctgggaaaaccatggtcgctatcatgctcgcgcgggagcacgtcctccgcgcgcgcgctggggaggcgctgcgccggatcgtggtattcctcgcgcccaccgtgcacctcgtccaccaggtgcgcgtctggtggcccgtttgtcttctccacgcgggaatgtggtggctggaggctgtgttgttgatgagggaagcggttgcctttccgtgtttgtgctgcagcaattcgaggtgattcgggagtatacagacctcgacgcggtggagtgccatggggcatcgggggttggccactggaacgccaagcgctggaaggaagcaattgggactaaggaggtacgcgccagggttcactgaagcctgccctatgcttgagcttgacacagtaattgagcaattgtgatgtactgtgagatttatggactaccgtgcctaccaactgcctgactaatggcctggaacagcaagcgtcctgtaggggctgtctgattggttgcctccatatgctccagccagacacacgagatgcaggctactgctgtttggtaacctgtatcgccacatgcaaaaggggctttcacgttggctccgtaaatatgtagattttggacgtttttgtggagccaggcccatttgaatgcagcttcttaaccagctaatgattttattagtgtgtgattagcacatatggagtaatattaatatatttcaaagaatattaaacacaataagataaaataaggtctataaaagtgtacttgcacaaaataaatattatagcaaaataattttagcggcttctatttcatgcatcatatctctatacaaacaaccatacaccatctctttctagctaggctaactagatacatgtaaccaaacaccatgcaattgcatgtagccagtctggttgagataggccaggctcacaaatttgagccaggttggaccatgcaggcaaccaatcggatccttagtgttgacagcactgctttttgtgagtagtgctcatcctgagtcaatgtagattgacgttatttttttcataaatgcagtagttcttgacaaaaaatattcttcagtcctggctgaagtacatatacatatgaaatatcctccatctttccgttgctacatggatacttctctacatcagcaaattctcataatccttataaatatgccattgtgatgaacttacatggctttttaatgcattttcttctcttggatttcagtcatttatatgattattcgcttttcagttcaaattcaaagtgctatctatgatttggaatatgtatttactcaagccatgactctttccgtttcttctccctcagattgttgttatgacaccacagatactattggatgctctcaggcatgcttttctaacaatgcgtgtgatgagcttgttaatatttgatgaatgccatcgtgcttgtggaaaccatccatactcactaataatgaaggtaacacaatttgaagatcgtttctttgttttgacttatatttttagataggctttgttccaaactttgcttgagactgaaatgctttgttgttgttgttggtgtttgttccaaactcccttgcattttttgtatagtacatgggttgcttaagccttagtatcacattttctaaataaatgtcatgcaaaagtcctaatgtctttaactcggcttgtgtttaaaggaattttacattgattcggagtggaggccagctatatttggaatgacggcgtctccagtttctaaaaagggtaggagtttctgtatatgacaatcatgtgtaatttctctttttgtcaatcgtttcagcaattatgctgtattgttattttaattatcatgttttatgactataattgtcttcctttttttgtcatactgcataaaaactcttttgataaatttatggtacattcatactccattttggtgtataacacttcttttttctgatattgatacatgttttatgcatcacaagacagtgcattttgggagtgtggtgttctctcttgtactaatgctgctctacttctcagcagtataaatttctaggttatctagcttacatgattagttgatgctttaattttttgtgattttgtgcatctaacttacttcttgggtgcactctgcatttccttgttaattgttttctagggctactattcatcctactggaagctacatatgactaatttactgagtcaaagttgtttctgatctatgactgttttcttaggcatatatttttgttactaattatggtagattcacattttttggatccctagctattatttgggtagggtcacgcagccagtagcacgggagcactattagaatatattgtcctcttggattcacattcctactattaaatgtgccatggtattctattttacatttagtatttactacaaccttctatttataaacaacaacaacagagccttttaattgcaaacaagttgggataagttagagttaaaagccaagagaagccacaagtcaaggttcacgtatgtggataactgttttccatgtactcgtattcaaggctaaatctttaagtatattcctttcaattctccttgtactgtctctttgtgtatcaacttcggtctttctagacctcttttttcattactatcgtgccttaggattccactacgcgctggtgcctatagatgtctctgttggacatgctcaaactatctcgatcggtgttggacaagcttttcttgaattggtgccacccctagcctatcacgtatatcatctttccagactcgatcaattcttgtaggtcataaatccaacgcaacctacgtatttccgcaacacttatctattgaacatgtcgtttttatatggtaacattttgcaccatacaacataacatgtctcattgttgtcctataactcacactttagcttctatggtaccctcttgtcactagaacgtcatatgcttgacgtcactttatccaccctattttgattctatggctaacatctttatcaatatctctgtctctctgtagcattgatcctaaataccaacttatccttcctgaggattacttgatttccaaactaacatagtcttcctcatgtatagaaggttgtgaagcacataagctaaaaccttatattttataggagcttctactatagaagattgtgaagcacagattgctcaacttgagctagtattggatgccaaggttctttctctcttgcagctaatgtttccttaatttttaaatttactgagttcttttaggaaacccaagtttgcagcagcaaactgatttaaatatcttacacgttatcccaggtatatattgttgaagataggaatgaacttgagagcttttcaactggtgcaaaagttgtgaataaatactatgacccttacttgtttgatttggataatctggaatcaaagttacagatgctgtttgaggaggtgacttaaccaaccaactatatatttcttctgattcactagaaaaatgtgtttttcgtagccacagcctagatacctagtatctttttctgcttgtacttacgtataggtttatataaatattgtactgttgggcagtttgatggtttgttggttagactgcaagaatcatctcctaataaatttgaagacactgatagtatattggagatgtcgagaaagagcttgtccagatgccatgggaagatattgtacgaactaaatactcttggtccaattgttactttggaggtattgttttatttaagcaccaagtatttctttttttactgaagggttataatgtccattgtgtcctgcgcgttcgataaaaaaataatgtccattgtggcattgtgctacattctatttattgatattgattagtggcaacaattaatatgcaagcaaccattaggtgcaaacgtgcaagcatgtttcttggtccattcgatttagatccaaccctagatgtaatcgtggtttgttagggtttttttataaagcagcccaacgtggtagtggaagggtttatgtgctaaatatgacatacggttggatctagatcgaatggaccaaaagacctgcttacacgcttgcacctaatgactgcttgcatattagttgttgccattgattagtagctgcataaattcctgtgtccttagtgactcctaattcctacacatttgttaattaatcccattgactctggcctggccagggaatatactggattaagaaattggcaatgctaatttaataggtcacctttgttgtaggaaacaccattaaaataccctttcccttgtttcacaaaagaaaaaaaaggctctgttagaatgtattgcgtgtgtgctgttattgtaatgtgcataggcccacctaactctctattaatacatccccaaccctatttagggttagggtttcactctcctaacaggctccactcagtgaatacatttgccctcctttctgaaaaatttctgattgtttccctgccagtcttaataatgtagcatttgcactgcaaaccatattaccataccgtaccatttgtattagaaaatatgtggtcctgatcgtatgttctgaacattcacctgtagccttttcgtttctttagattttttttttcagttttgaaggactatgttgttcgttctagaaaatcatacatgcatttatctagcaatcttattaaccagagtaactattggtacaatttgaatgtttatatgctaactctttattacatttctctgataggtggtgaagatatataatgaaagcattaataccatagatgattctgaagattgcgtattttctaaagagagcctcaacttacaggtttcctatttcaaagaagctttatttttgattgaagattttttgccacagggtatgatgcattattttactgaattcttacgatactgtcaccagctttgaaactacagtttttatgtatcaatatttgttttctaattcttgtggcattgttctataataggttatggggagctgatgaaatcagaatctggttctgcggaactaactaagaagggatatatttcttctaaagtggagtcactgatcaacattttcaaatcgtttgggtaataccttagtccacttaagatgtttattctattcttttgtttagtcttttgttcgtacaaagatacatttacatgtgttgtctctacagctcgtcagaggaagtgctttgcatgatttttgtagaaagaattacgacagccaaagctgttgaaaggtttatgagaggaaatgtgaacttctctcgtttttcaatttcatacttgactggagggagtacatcaaaagatgctttgagcccagcagtacaaagatttactttggatttgttccgagctgggaaggtattatattttgctagtgcaatttgattggaatattcaaatgatatactaacttttatgtcaatttataggtgaatttgctttttacaacagatgtcactgaagagggtattgatgtacctaactgttcctgtgtgatacgttttgacttacccagaactgtttgtagctatgtccagtctcgtgggcgtgccagaaaaagcagttcaagttatgttcttatgattgaaaggtaaaacattgccacatttaattaactttttttttgatatgggctgtttagctataaaaaagtttatatggtcaccaatattttctcccttcctgagttacacctgttcttaaaccttttcttatatgcttggtctggaactttcaggggtaacttggcgcagcaggaacacatatttcgtataatacgaactgaatactatgttaaaacctttgcactgcataaacaaccaaatactccatcacttgatttgcctctccaagagaagtacatataccatgttgaatcaacaggagcaactatcaccgcagaatgctgtgtcaacctaatttataaatattgtgagaagcttcctaaagataggtatgcttgtgcttttaatctgcttatgttcgttgatctgcaaagggcaggtcttgtgctgtggtgaagcgaaagggcttctaactgagttcgttaggtggtataagtagaactccccaggtcctgagttcgacatcccgtgggagtgaattttaggctggggttaaaaaaattccctcatctgttccatgccaaagcacaggcctaaggcctggtctcggtcgttctcatatgggctacggtgtcgttgtgtatgtgtgaggtaggttttttttgcgctgtggtgaaagctgtctcactgagtaatcaggttgtgggttcgaagcagtctctcatcatttgcagggggagatggcttgccttgttttattaatccttcctcagatcccactcatgtggagcccctggcactgggtctgcctattttatctgtttgttaatctctgtgataacaggaaacccagccatattataatacaatcactatatctctaacactctgtttcaacatatgcatgactgttatgcttaaactttcatttggatttgttcctgttatgggtagtatttgcatgtgggctgaaaagttgatcaaactgaaatgtcactcataatggaataactacacctcctaccccatgatattgctgtattttcgttgcataaacatggtgcttcacgataggattcctctccaggtattacttgccaaagccttgctttgaggtgggtcttaaggatgggtcatatcaatgtaccttgacaatgcctcacaatgctgcatttcgaagtatagttggtcctccaagtagttcatgtaatttagccaagcagcttgtatgcctggaggcatgcaagaaactgcacgagctgggagaactcgatgatcatctagtacccttgactgaagagcctatggatattgatacagacacaacagataaaaaatgtgtttctggaccaggtatggttctaatgtctttcaagtgttgcttcgtgcttacatcaatgttttattgagaggaatacctcttcatatatttagctctgtttcaacaataaaatactgtacagtgagtgagtctgtttatagtggttgtgactcagaacgggcatgaactttttattttttgacagtgccattattcttggggcatggcgcttatggctacaaaggaaccgggtcatctttgatggggaatctctttccataagcataagcaaagtgcaaagaagttttttagatgagttagtttgttgggtgatggctggagcgaaacatcttgggaatttaggcttagtgggagctcttaatgtcattgtcatcgggtcgagttagattctaatatgtaatagttcttttgtgtgtgtggttttggggcctagcatgccccccccttctagttgtaagaccgtttttctcctctctaatatataaagatgcgcagctctcctgcacgtcgagaaaaaaagatagaacttgatgaactagtggtgattgaatctgtttgtttccttgcatggtgcatcatatttacttgtgccgaaactctcttcatatatgttgttatctttgtgaacttgtttattaagaaaatgtctccagaccattgaaccctgtcacctttatgtaactatctctcatttgttatctttgacatttgattgagcaatcactgaatacttactttgcaaatggaagttggcagtagcattcccatgaagtattagcaacagctacaagtgtttctccttctgaagaagattttatatttttttcatgcccttgccctttcaccattttggcaggaacaactaaacgaaaggagcttcatggaacgataaatgttcatggtctatctggaaactggatccatgaaagtgaaactgtgattctgaatgcttacacatttgattttcgttgtgatcaagaaggtgaactttatgctgggttcgttctcttaatggaatcagtacttgatgatgatgtggcacgttcagagatagatctcttccttatacctaataaaatggtgtacaccaccatgactccttgtggaaaaattcaactgaacaaagagcaggttattcaagaaaccgcaactcctgttgctagatttctttttaagtttaccagtggcttactttccttagtttttttgtcagctgtgtaaaggaaaattattccaagaattcttcttcaatggtatatttggtagattatttcatggttcccgaacggatgaactgcaaagggaatttattttcacaaaaggtcatgaaatacaatggggctcagacaacatgtacttacttttgcctttgaggaactcttcacagatacaacatgatccaaacatatactgggaagccgttgagtcttgctctggtacagtagagcagttgagaaatttgtatctagaagatggaaatctcaaccatgaaaacttatgttcacataaaagaagcaacaagggagaagacatcattcatctggccaataaatctcttcatttttccacagtcaaagattcagttgtactatctcttcatactgggaggatctattctgttcttgacttgattttagataaaactgcagatgactcatttgatgagatgtataatgggaaagcttcaccatttgcttcatttgtggactactaccatcaaaagtagttgctcatttttaattttgtcaattcaaggatggatccactatgttatgcttgctcactaatttctccgttctcaactatatgtaggtatggtattgttattcaacatccagggcaacctttgttgctgttaaagcaaagtcacaatgcacacaacttacttttttcaaaaatgaagtaccaaggtactgtagtctcgatgtagtagcattctttccttttttctgttgcataatttgagatggtaattgtgttactttggctctgcttttacatggtattccatccaatttatggcagatggttcaactggcaatcctctgctcgtagaaaaagagcaaattcatgcccgagttccacctgaactactcatccatattgatgtcgcaactgatattctcaaatcattttacttgctcccttctgtaatgcatcgggttcagtctttaatgttagccagccagcttcgcagcaacattagttacattcaacgcataccaagttctctggtctgttctctcatggtattacatattgttttatttgttaaggatagtaatgcatataatgacttctcttcatgctagattttggaagctataacaactttaaggtgctgcgagtccttttctctggagcggttagagttattaggagactcagtactgaaatatgtaataggatgtgatctgttcctaagatacccaatgaaacatgaaggccatctctctgatatgagatccaaggcggtatgcaatgcgacactgcataaacatggaatatggcaatccctgcaggtagatgctttcaagcctaagttcatttgtgtgatcattttgctgaagttcataaatggatctgtcaatattcttacatcataattgaaccagttttgtctgagagtgacaccaataattcattgtcgtcatttaacaaaacttggaatttcccagaaggtttatcccgaaggaataagatacatgctattcatgctagaatggatagactaatccagttagacattttcatgttctgtgctacccatctgtagtttcctattataggcctaatcacttgtgtcatcttttctttgaagtctttcctttttattaggtttgtttttatttaatgtatatctactaatgctttcagggttatatacgtgatgctgcatttgaccctcgtcgttgggttgctcctggacagatatcattgcgcccttttccttgtaattgtggaatcgaaactgcatttgttccttttaatggaggttatatcagtgacgatccatcttttgttgtgggaaaaccatgtgacagaggccacagatggatgtgctcaaaaacagtatctgattgtgttgaagcactagttggagcatattatgttggtggtggcatcgctgctgcaatttgggttatgaggtggtttggtattgatgtcaggtgtgatatggaactagtgcagaaagcaaaatataattctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccaggtcagtgaagcagagtttcagtacattagtttattgcatttaagtcacattgatatacatatcttaatttctgatttgtaacagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttagaaaacttagttctacttctgtttgtggattagcagcctatttttctttattgtatttttatatatttgagtgaataacatggagctctcctttgtgttcccattaaaaattgtgctttcattgtttgttcaatatttatctatttttactcagcaacgtagaactttccaaggcataggaagctaattttaatttccttgcacaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaaggtatatcttttcaaacagaaacaaaatatcaagaaatgtctagtttaaggggttgggcaggtccattgtgaaag

SEQ ID NO: 678 - DNA, 13731 bp, Zea mays
taaaaccttatattttataggagcttctactatagaagattgtgaagcacagattgctcaacttgagctagtattggatgccaaggttctttctctcttgcagctaatgtttccttaatttttaaatttactgagttcttttaggaaacccaagtttgcagcagcaaactgatttaaatatcttacacgttatcccaggtatatattgttgaagataggaatgaacttgagagcttttcaactggtgcaaaagttgtgaataaatactatgacccttacttgtttgatttggataatctggaatcaaagttacagatgctgtttgaggaggtgacttaaccaaccaactatatatttcttctgattcactagaaaaatgtgtttttcgtagccacagcctagatacctagtatctttttctgcttgtacttacgtataggtttatataaatattgtactgttgggcagtttgatggtttgttggttagactgcaagaatcatctcctaataaatttgaagacactgatagtatattggagatgtcgagaaagagcttgtccagatgccatgggaagatattgtacgaactaaatactcttggtccaattgttactttggaggtattgttttatttaagcaccaagtatttctttttttactgaagggttataatgtccattgtgtcctgcgcgttcgataaaaaaataatgtccattgtggcattgtgctacattctatttattgatattgattagtggcaacaattaatatgcaagcaaccattaggtgcaaacgtgcaagcatgtttcttggtccattcgatttagatccaaccctagatgtaatcgtggtttgttagggtttttttataaagcagcccaacgtggtagtggaagggtttatgtgctaaatatgacatacggttggatctagatcgaatggaccaaaagacctgcttacacgcttgcacctaatgactgcttgcatattagttgttgccattgattagtagctgcataaattcctgtgtccttagtgactcctaattcctacacatttgttaattaatcccattgactctggcctggccagggaatatactggattaagaaattggcaatgctaatttaataggtcacctttgttgtaggaaacaccattaaaataccctttcccttgtttcacaaaagaaaaaaaaggctctgttagaatgtattgcgtgtgtgctgttattgtaatgtgcataggcccacctaactctctattaatacatccccaaccctatttagggttagggtttcactctcctaacaggctccactcagtgaatacatttgccctcctttctgaaaaatttctgattgtttccctgccagtcttaataatgtagcatttgcactgcaaaccatattaccataccgtaccatttgtattagaaaatatgtggtcctgatcgtatgttctgaacattcacctgtagccttttcgtttctttagattttttttttcagttttgaaggactatgttgttcgttctagaaaatcatacatgcatttatctagcaatcttattaaccagagtaactattggtacaatttgaatgtttatatgctaactctttattacatttctctgataggtggtgaagatatataatgaaagcattaataccatagatgattctgaagattgcgtattttctaaagagagcctcaacttacaggtttcctatttcaaagaagctttatttttgattgaagattttttgccacagggtatgatgcattattttactgaattcttacgatactgtcaccagctttgaaactacagtttttatgtatcaatatttgttttctaattcttgtggcattgttctataataggttatggggagctgatgaaatcagaatctggttctgcggaactaactaagaagggatatatttcttctaaagtggagtcactgatcaacattttcaaatcgtttgggtaataccttagtccacttaagatgtttattctattcttttgtttagtcttttgttcgtacaaagatacatttacatgtgttgtctctacagctcgtcagaggaagtgctttgcatgatttttgtagaaagaattacgacagccaaagctgttgaaaggtttatgagaggaaatgtgaacttctctcgtttttcaatttcatacttgactggagggagtacatcaaaagatgctttgagcccagcagtacaaagatttactttggatttgttccgagctgggaaggtattatattttgctagtgcaatttgattggaatattcaaatgatatactaacttttatgtcaatttataggtgaatttgctttttacaacagatgtcactgaagagggtattgatgtacctaactgttcctgtgtgatacgttttgacttacccagaactgtttgtagctatgtccagtctcgtgggcgtgccagaaaaagcagttcaagttatgttcttatgattgaaaggtaaaacattgccacatttaattaactttttttttgatatgggctgtttagctataaaaaagtttatatggtcaccaatattttctcccttcctgagttacacctgttcttaaaccttttcttatatgcttggtctggaactttcaggggtaacttggcgcagcaggaacacatatttcgtataatacgaactgaatactatgttaaaacctttgcactgcataaacaaccaaatactccatcacttgatttgcctctccaagagaagtacatataccatgttgaatcaacaggagcaactatcaccgcagaatgctgtgtcaacctaatttataaatattgtgagaagcttcctaaagataggtatgcttgtgcttttaatctgcttatgttcgttgatctgcaaagggcaggtcttgtgctgtggtgaagcgaaagggcttctaactgagttcgttaggtggtataagtagaactccccaggtcctgagttcgacatcccgtgggagtgaattttaggctggggttaaaaaaattccctcatctgttccatgccaaagcacaggcctaaggcctggtctcggtcgttctcatatgggctacggtgtcgttgtgtatgtgtgaggtaggttttttttgcgctgtggtgaaagctgtctcactgagtaatcaggttgtgggttcgaagcagtctctcatcatttgcagggggagatggcttgccttgttttattaatccttcctcagatcccactcatgtggagcccctggcactgggtctgcctattttatctgtttgttaatctctgtgataacaggaaacccagccatattataatacaatcactatatctctaacactctgtttcaacatatgcatgactgttatgcttaaactttcatttggatttgttcctgttatgggtagtatttgcatgtgggctgaaaagttgatcaaactgaaatgtcactcataatggaataactacacctcctaccccatgatattgctgtattttcgttgcataaacatggtgcttcacgataggattcctctccaggtattacttgccaaagccttgctttgaggtgggtcttaaggatgggtcatatcaatgtaccttgacaatgcctcacaatgctgcatttcgaagtatagttggtcctccaagtagttcatgtaatttagccaagcagcttgtatgcctggaggcatgcaagaaactgcacgagctgggagaactcgatgatcatctagtacccttgactgaagagcctatggatattgatacagacacaacagataaaaaatgtgtttctggaccaggtatggttctaatgtctttcaagtgttgcttcgtgcttacatcaatgttttattgagaggaatacctcttcatatatttagctctgtttcaacaataaaatactgtacagtgagtgagtctgtttatagtggttgtgactcagaacgggcatgaactttttattttttgacagtgccattattcttggggcatggcgcttatggctacaaaggaaccgggtcatctttgatggggaatctctttccataagcataagcaaagtgcaaagaagttttttagatgagttagtttgttgggtgatggctggagcgaaacatcttgggaatttaggcttagtgggagctcttaatgtcattgtcatcgggtcgagttagattctaatatgtaatagttcttttgtgtgtgtggttttggggcctagcatgccccccccttctagttgtaagaccgtttttctcctctctaatatataaagatgcgcagctctcctgcacgtcgagaaaaaaagatagaacttgatgaactagtggtgattgaatctgtttgtttccttgcatggtgcatcatatttacttgtgccgaaactctcttcatatatgttgttatctttgtgaacttgtttattaagaaaatgtctccagaccattgaaccctgtcacctttatgtaactatctctcatttgttatctttgacatttgattgagcaatcactgaatacttactttgcaaatggaagttggcagtagcattcccatgaagtattagcaacagctacaagtgtttctccttctgaagaagattttatatttttttcatgcccttgccctttcaccattttggcaggaacaactaaacgaaaggagcttcatggaacgataaatgttcatggtctatctggaaactggatccatgaaagtgaaactgtgattctgaatgcttacacatttgattttcgttgtgatcaagaaggtgaactttatgctgggttcgttctcttaatggaatcagtacttgatgatgatgtggcacgttcagagatagatctcttccttatacctaataaaatggtgtacaccaccatgactccttgtggaaaaattcaactgaacaaagagcaggttattcaagaaaccgcaactcctgttgctagatttctttttaagtttaccagtggcttactttccttagtttttttgtcagctgtgtaaaggaaaattattccaagaattcttcttcaatggtatatttggtagattatttcatggttcccgaacggatgaactgcaaagggaatttattttcacaaaaggtcatgaaatacaatggggctcagacaacatgtacttacttttgcctttgaggaactcttcacagatacaacatgatccaaacatatactgggaagccgttgagtcttgctctggtacagtagagcagttgagaaatttgtatctagaagatggaaatctcaaccatgaaaacttatgttcacataaaagaagcaacaagggagaagacatcattcatctggccaataaatctcttcatttttccacagtcaaagattcagttgtactatctcttcatactgggaggatctattctgttcttgacttgattttagataaaactgcagatgactcatttgatgagatgtataatgggaaagcttcaccatttgcttcatttgtggactactaccatcaaaagtagttgctcatttttaattttgtcaattcaaggatggatccactatgttatgcttgctcactaatttctccgttctcaactatatgtaggtatggtattgttattcaacatccagggcaacctttgttgctgttaaagcaaagtcacaatgcacacaacttacttttttcaaaaatgaagtaccaaggtactgtagtctcgatgtagtagcattctttccttttttctgttgcataatttgagatggtaattgtgttactttggctctgcttttacatggtattccatccaatttatggcagatggttcaactggcaatcctctgctcgtagaaaaagagcaaattcatgcccgagttccacctgaactactcatccatattgatgtcgcaactgatattctcaaatcattttacttgctcccttctgtaatgcatcgggttcagtctttaatgttagccagccagcttcgcagcaacattagttacattcaacgcataccaagttctctggtctgttctctcatggtattacatattgttttatttgttaaggatagtaatgcatataatgacttctcttcatgctagattttggaagctataacaactttaaggtgctgcgagtccttttctctggagcggttagagttattaggagactcagtactgaaatatgtaataggatgtgatctgttcctaagatacccaatgaaacatgaaggccatctctctgatatgagatccaaggcggtatgcaatgcgacactgcataaacatggaatatggcaatccctgcaggtagatgctttcaagcctaagttcatttgtgtgatcattttgctgaagttcataaatggatctgtcaatattcttacatcataattgaaccagttttgtctgagagtgacaccaataattcattgtcgtcatttaacaaaacttggaatttcccagaaggtttatcccgaaggaataagatacatgctattcatgctagaatggatagactaatccagttagacattttcatgttctgtgctacccatctgtagtttcctattataggcctaatcacttgtgtcatcttttctttgaagtctttcctttttattaggtttgtttttatttaatgtatatctactaatgctttcagggttatatacgtgatgctgcatttgaccctcgtcgttgggttgctcctggacagatatcattgcgcccttttccttgtaattgtggaatcgaaactgcatttgttccttttaatggaggttatatcagtgacgatccatcttttgttgtgggaaaaccatgtgacagaggccacagatggatgtgctcaaaaacagtatctgattgtgttgaagcactagttggagcatattatgttggtggtggcatcgctgctgcaatttgggttatgaggtggtttggtattgatgtcaggtgtgatatggaactagtgcagaaagcaaaatataattctaatgcatctcgaatgtgctatttatcaaaaataaaagatattgaggaactggaagcaaaactgaagtacaacttctcggtcaaaggccttctgcttgaagccatatcacatccatctgtacaggaattaggagttgactattgttaccaggtcagtgaagcagagtttcagtacattagtttattgcatttaagtcacattgatatacatatcttaatttctgatttgtaacagcgtctggaatttcttggtgattctgtgctggatctattaatcacacagcatctctatgctacccacactgatgttgatcctggagaattgacagacctgcgttccgcttcggttagtaatgagaattttgcacaagcagttgtaagaaacaatattcataatcatctacagcatggatctggaatacttttggaacaagtaacagaatatgtcaggtccaacttggagtaccatggtaaagagaatcaattccttcaacaagctacatgcaaagcacctaaggttagaaaacttagttctacttctgtttgtggattagcagcctatttttctttattgtatttttatatatttgagtgaataacatggagctctcctttgtgttcccattaaaaattgtgctttcattgtttgttcaatatttatctatttttactcagcaacgtagaactttccaaggcataggaagctaattttaatttccttgcacaggttcttggagacatcatggaaagtattactggtgcaatatttatagatgtaaattttgatgttgatctggtttggaagattgttgaaccgttactttctccaatgattacccctgataagcttgcgttgccaccttatcgggagttgctggagttatgtagtcaccttggttgcttcatagagtcaaaatgtactagtgaaggagaagagttaattattgagatgaaggtgcagttgcgagatgaacaactgatagcacaaggacatgacagaaatggtaaaaccgcaaaggcaaatgcagcagcccgaattttggtcgacatgaaggtatatcttttcaaacagaaacaaaatatcaagaaatgtctagtttaaggggttgggcaggtccattgtgaaagacagtgtattgggtaaatgttgaatgattaatgggagcaaaggctcgtctacatataggcaaggatgttcacaggaataggaaactatcctagacaataggaaactctcctagacaataggaagcaatcctagacaatccaatcagggaagatccttgcctattagaaccaattaaccaaactaggggacgacgcacaaggcaacatgcctgtgcagccgcactaccctaaacccaagggacctgcctaacatagcccattttaacacccccctagtcagatcgtcaaccactgcacaagttcaaactggtcctgaattcagtgaagactgatggaggcccttggtgaagatgtctgcatactgtgatgtcgtcggcacatgcagggcatgtagatcaccagcagaaacccgttctctgacgaagtgaagatcaatctcgatgtgcttggtgcgttgatgctggacggggttggaggtcatgttggcagcactgatgttgtcacagtacaccaatgtagcttgacgaagagggacgtggagttccaagaggagctggcacaaccatgtagcctctacaactccgtttgccagaacgtgatactcagcttcagcactagacctcgagacaatgttctgacgcttggaggactaggagacgaggttgtcaccaaggaacacatcatagcctgaggtgaacttgcgtgtatccaggcaatccacccaatcaacatcagtatagaccacaagatcagtcgttgtagatggtcacagcaggaggccaaggtcaagggtgccacgaatgtatcgaagaatcctcttaagtgcagcaagatgtggtcccaggagcatgcatgtcaagacaaacttgctgaacaacataagcaatatcaggccgagtgaatgtgagccactgtagtgcaccagcaagacaacgaaaatccgaggcgccagtcaccggcgcaccatctgctgaggcaaccttcgggttggtgttaactggtgtcagacagggcttgcactctgacatccctgcgggctcaaggagctcgaccatgtactgcttctaagaagaagaccatcgtctgagggctgaacatgcataccaaggaagtgatgcagcacaccgagatccttcatggagaactcctgttgcagggctaagatgatatgacgcaggagggcagaggaggaagcggtgaggacaatgttgtcgacatagagcagcaaataagcaatgtcggatccacactgaaagacgaagggtgacatgtctgacttggcctcaacaaaactaagggagagcaaatatgtggcaaatcagttgaaccatgcgcgaggagcctgcctcaaccatagagggacttgttcaatcgacaaacaagatctggatgtgtagggtcttccaatccggatgactgaatgcagtacacagtcttggacagagtgccatgtagaaaagcattcttcacatcaagctggtgcttaggccatcgctgggatagtaccagggagaggattgtgcgaaccgtagctggcttcaccacaggactgaatgtctcaaagaaatccacacttggacgctaggtgaaaccctgaagaacccatcataccttgtgccgctccagtgtctcgttggcattgaacttgtgcttgaagacccatttgcatgtcaccacgttggcatgaggtgaccgaggcacgagatcccaagtgtggttatgttgaagggcgacatgctcttcctccatggcggcatgctagctcggatcagcgaggccaccacgataggtcttgggcaccagggagagttgtgcagcatggaacagggctggaacgcgaaagccacgcttagcgcgcgtcgccatcaggtgttggttggtcacttgctggacatcaacaacacccttgggaagcggtgctggagacggtgacgggagcgctggtgctggagacgatgctgttggcgacagaacaagatccgtgggttcccggcgcatgtagacattggtgatgacgcgcgccggagcctggagaggtagaaagcctggcggtgagccacgcgtggcggcgcccggggacatttacgccgcgcggggcgctgacgaaatgcaggcggggcatggggacgcaacaggcgatgacgacgaagtctacaaataatgtgtgcaattgttaaggatgaccaaataatatttataactagacacactgacaaccagagatgtccaaaggttgcaatgtataagatcaaacttattagatgcatgagaggtagacacatgaaagggcaggtgagcatagcgccctagctgacaagcatgacataaagtggaggaatctctaaatgaatggagacactagacgcgagcttcgatagagcttcatgaccaggatgaccgagatggcggtgccaaggggggaggtggccttggcgacaaaagattgagctggaggaaggtgtaggggtacaggaccctagagctattgcgcctgatgatcatgttctgagtttgcagatccttcacagaacaaccagcatggtcaaactcaacagagcaattgttgttgatagtaattggcaaactaaaataagattcttaataatttgtggagacacaaggatattattaagaaataaagagtgagataattcagtacagccagtgtcaaccataggaagcagggagccattgccgacaacaatggatgaaggagtaggatactgcagggaaaaagtgtgtgaaagattgttgtaagaagatgtcatgtgggaagtagcacctgaattgaagtaccactcggtggacgggggttgctgcagcgtctccgtgctaaacccagaggccagcgactgattgtccctggagggcaggccgaccatggggtgatagaaccctggcggagcccattggtccccttagttggtgcagaaggagcaagagcagcaggtggctgctgctgggcgacgaaggcctgctgctgaggacgaggctgggaaattggcgacagaggaggacgtgtgccgggccacatgtggatggtgcctatccacgggttgtagaccgatggccaagggccagccgccggcataacatctttggtgtcgggctgctgctacccgctgttgttgctgcctgccgctgtcgtggccaccggcacgcttgctgcgactactgttgttcttggagctgttcccatggccacccccaccccgcgagttgaagtcggagagctgtgggggatgttgcgaggacttggtggcggcggcaagagcgacgaccataagaggccgctgatttgccagggtgaggtcatcgcagacgtcgaggtaggaggggaagggtcgagcgtgacgaagcagggcgccgacatgggtgaagcgctcattgaggtcgcgaatcacattgaggatgagggtgcggtccgagacgacttccttgagggcaccgaggtcgtcggccatcttgaggcggcggtagtactcggcgatggagatcgccctggacgaagttgtgaaaccttgtctcaagctggatggcgtgtatctcccgtttcccaaggaaccgaactcgacggcgagccaggtgtcccgggcagtgccaccctgggaggagacaatctcgacaaggtcgtatgtgaggcagtcgaggttctaggacttgacacaatccatttgatcccaatccggagaggggaccagggcgtcgaggtggacgtgatcctagagggagaacttgccgagggtcagtaaaaactaatgacgccaacggttgaggtggccagagttgacgttgaggacgatgtggacgaggctctggatgttggtgacaacgacgaccttggcgtggaggtggagggcggcggcctcctgcagtagcctggcgccatggagatccacaggcgtgggcatagaggacttgtccctgtggagcggggggcaagggcgatgccagtggcgcgagcctcctcctctgtcgcggcgaggcgggcaagggccacgtcgtaggcccgctggcgcttcaaggcgacgacgctgaccatttccgtggcccggcgggcggcgatctcgtcctgctggacgtgggtgtggatggccgaggatgacgagtcgacgaggccggcggtagccgccctgggcggtgtcgcccttgggcgacggaggcgcaatgccgagcatggcgctgcacagcagggagggtggcgcgcgggcgctataggtcagtaagacgggcgctgcacggcagagaagccgacacgcttattggggcggaagcgaagaaatccgatgtggaaccctgacaattgataccatgaaagacagtgtattgggaaaatgttgaatgattaatgggagcaaaggctcgagtacatataggcaaggatgtttacaggaataggaaactatcctagacaataggaaacaatgaagatccttgcctgttagaaccaattaaccaaactaggggagggcgcacaaggcaacatgcatgtgcagccgcactaccctaaacccaagggacctgcctcatatagcccatgctaacacattgtgatgctaatgggtagttcaacttcaactacacaccttgggtgtaactttctattctattgtaatgactgctttggcagtagatgctactccttcctgtcggaaatccatgatggtttgaaccggtggcttgaactgtaggcaaaatctgcctctcgagcgtcatgtatttttttgaaaggatggagtatgttttgctgactattttagaactggtttaatttttttctgaatgcagaaacggggtctctctcttaaacaatgcatctcgaaggctaatcaattggatattgtctcttcaaaactgcaatcagaattgacaaatgtaagcttataaagtgtttcccacaaaatggtacatcaaagtaatgaacttaattctgattctctgagtaatgaatagtatcgcatctctgtagttggaatcgcgacatgattgtcctcacatgaatggcactcttagcctaggtctttcctcagcgagagcagcaggtaatgccctgttttggttaattactctccctctgttccaaattatagttcactttagatttatcttaagttcagtttctctaactttgaccaaatttatagaaaaatgtatcgacatttacaacatcaaattagtatcattaaatccttcatgaaatatattttcatagtgcatttacttgaacctgaggtattaatatagtgttattaaaacttcttcaaagttagggaagtttgaattaagacaaagctagaatgaactatgatttggatgaatggagtatatggtactcactggtcagggtatcaaataggaaatattagtaattagatttgttctatacctagctctagcagccacaaaatacttagcattactcagatgtcatggcctttcatatgctttcagttgttcttcctctcaaaatggacaaaggtggacctcggactgcactttttaggctatgcaagagtttacagtggccaattccagaatttgaatttgtggaacaaaggtttaggtat

SEQ ID NO: 679 - DNA, 6460 bp, Zea mays
cacgtataaatggcccatgttgcagggtcccacttgtaagctgataagagggcagagttgttagtgtgtctgtgtgtgcttgtaattaatcacgctgtaatgacccaccataacccccaagggagaatattccagggataacataggtaaccgagggcacaatcgtctttgatagggtagagttgtccctcggttacctataaatacccccgtacagtccattgcgggggacggaaaaacagtgttgccctaatactctgtgttaaacggcatcaaactttttcctgttctcccactgtttgagcttggctgaccacgagttagcgagttctaacagggggtcatggtctgaattattggagctagagtccaagagctctagtttaggtgactaaaagttaggtgatgctatgatgacagaacgatgctataggtgccaaacttcccacgggtgtcgtaccaaacacactaggatatcaaaagtacttgacgaaagattgtttagggagcgaggagtgaaccctaacaccgtgaagtatgcctactaggtcacgacattttgagcctaacacatagatttttatagagtttcgagtcgtaatatacgtcctcttactgatcatggattagcatatatatagatggtatgtaagattgcaagcctaagatcaggacagatagctcctctttggaggggagtagataaggcaagctactctaacacttttgttgccgcctttgtccgattgtcttttaggtctcccgacttagctttgatggatactatttgagatataaacgataaactaaaattaattatatatgtgcgtgagtatcaaaatatcacacaatataataaataatttaatagtatattttatgtaaaattataaaaatcaatttagatctatcatgatatacccatgacaaggctattctcggtaggagtttgattctcattaaatcataaagccacataagcaaacagaatgacatgtcatgcaatttaataaaaagaagtataagagaattttatatggtgaaactttgaatacattgtttctaaataaatattgatctgacagccttaaaaacggtgcataaaactatatctacgaaaatgatctaattataataaattaaatactagtatgctatattggtgacagctagcacactaaatacgtgacaactatagtatggttggtggcagcatctctgccaccaccatcaataaaacaactttttttctctttattgcattgagagttgggctacacccctaattatgcgttcagccgtgtggcttccaaagctcttcgggaaatgctctccacccgagtgaccactgatcagccgccacacgggatctttcaacccctacggcctacgcgtacctgggaccgttcagcaccgtctcgctgacagacatgacacacatgaggcggtccctacaaatgctagtggtgtacaacaagtgacgtgcccaatgcccgtgcagtttggcgggcgccgcgcgtatgtttctcgttgcgacttggaggagaaggagattcgccgtctcaccccttccctgcctgctccctcgtctaagaaaagcgggcagagcagagacggcggcggcaggccatcgcggactcccgctcaccctcgtctgccaccgcctcccaggtcaggggccgacggcgacgggtggggaggggcggcagaggtagtccgaggggaggctgtggagcggagggcggagagaggccacgccgtccggagtctccagttccgtcgccacagcttcctgccgcgcctgggccgaggtaaacgagagggatcgaggaagaagtatcccccggagccccttcccccgaacccgaaggctccggaatggcggtaagactttcctttctttcccatgcttttctttgctgtgtcctattccatatactgtgaggggatgatctctcgcgccatgaattcttgatgctcatagtctggtccgctgcgcgttagagtggggtccctgatgtcgcgacgttgggttttgttcctttctgctgctcaacataggggttttcttaacactggatcgagttagggacctgcattttgggtgttatttcgggttggatgatggtttcgtcctactgttgctcgatgtgcctgatgtcttgttcttaatccgtgtcacagcactgggttagcgacagtgatggcagtgacaactttgaatgggatagtgatggcaatggggaggagccagcgaacttcaatgctgctggtgccggttcatcagctctgagatcaacgaacactgatgctccaggtccatcaacacgggtaatccatctaactgatccgtacatatgctactatatgttcttcagttcatgttactcagggatgttcaaaccacttgtgccaacctggccggggtgggggtggatacatatggtcatcatgaacataatcaggatcatgattagcgtacagcgacacgaacactctcaatgttattgttaccttgtttgtagtggctacgattgtaatgtttctgtttgtttgtggggctgcttttaaggttgctaatggcaatgggaaggctgggccatctgcctccttggttcaaaagtatatggacatgggtttcacggaagagattgttcggaaggccatgaaggacaatggtgcttacccatttcttctctatttagattccaggtgatttatatactctatctcacagctgccttttctttcaggggataatggagcagattcattagttgagcttcttcttacttaccaggtatccatttgtgttcctgcttctatcagttattctttgatgattttgcatggtatcaaagaggatttttatttacaaagtgatgccaagtgcaggaactaggcaatgacctcaaagtggataacggcttcgcttctggttgtgccccccaaactgttgatgatagtgatgatgacgacattctagaaaactgggatgatgaggatgctgatggtgggagaagcaccagggttgctaactctattgatgattctgaagacgaggtattttcatgtgcccccttggtgactgtattcgtttactttattcttttgagaaacctgctatgtatttactttgcttcaataatatatacttctgcattaaacatgtttaatgttaatccagtaagtagactaattaccccgaaaaccataacgttccttacttttacttgcacatgttcctttgttttcaaacagctgttagctacatagctgtgctataaaggcaatctatttttgtttttcccttatatttttggacaactgagttctttgggccagaacagcatgttccaatgaaaccaaaatccttaattttgtaagaaaatcttatcagtaagacggtgggcaagatagttgtgtccatcataaacttggaactgtttcgtttcatcttatgcatatgaatagaactctcgtgttagtgatattcttgaacaaggcaccactgtggactaacaaatgaaattccaaaattgtgggtggttcgttactgatgataatcttatcttgtatgtggcattaatttctttttacttaagtttgctgtaccccctcttccctgtaacagcattctctcctactgttttaattcaaaaagaaaactttaggtatgggttattatctatttacattttggtatttatgcaaattgattagtgatcctgagaatttgaggctccgtagtgcaacaacattcttgttcgactctaacatggaacttgcatactttttggtgtttggcatgtgacttcatgtagctgagagttgattgaactggactacagctggagttccatttttttacgcagtacatttgtttttctcaataaaaaagctaattgttttccaaacttgtccatagttacgttacttcccatttctatacacattacaagactcattgtttttgtcctttggaaggtaattgcaatgctagtttatgtagcttgtcaacacaggatttctcagtgctctcctgtgctttcaacacaggatttcttaaatgagatgtcacagaaggacaagaaagttgattccttagttaaaatggggtttcctgaagacgaggctgcactggctattactagatgcggtgtgatttctgagccttttttccatgcccctctgtttgccttagattcgtcagcaaaataaacatcaatttccaacctgaaagtaggatatgctctcacttagaataaatctgttgaataataacattgccatgtttaattatatgccaaacattctattggtttatctctggattctgagaattttcctcaaatgctgtaagttggaactcgtaaactggctgcaatcttgaactgagataacctggaatggttgattctttccaagcttgatagactgattgcacctggttaaccagttataaatctgaagacaaatcagttaggcatgcccacaataacttgtagaaagcaaggtgtatgataaatattgtttcttagaagaataactgggattttaggaacttatccatccaattagtagatgtaaacctttgattctatgaataggaagcatccggatgctcaattcaaagcaggcaaccaacagtttattaatttttttggggtcagaacattttaaatgcatttgttgtcaaataaaactgttttttgcatgcaacttgtagaactcaggttctgtccttgtctctgttttattttgagttatcttcagagcttgtggtttaaaactgtttttattttaagtatgctccaaacgcccctgttcactgatcatgcaccttattgttgtccgtggtttaaaattactcagggcaggatgcatctatttctgttctggtggattccatatatgcttcacagaccgcaggagatggttactgtggcaatttgtctgactacgaggttcgttcgtcttaggtgacctgcccatacaagtctgcaataagatttagttcaaatttaatggtctgatgatggaactgtgtttgcaatactgcagggtaattccaatggagggagaaacaaaggaaggttcatggacgggaacaaaaaaaagagaaaaagatatggaggtcaagcacagggaaatagaggcccattagatggtagctgtgaagaacccatgcctctcccaaatccaatggttggatttaatttgccggaccattggacaagaccagtagacagatcgctgcctacacaagctattggaccaccatacttctactacgagaatgttgctcttgctccaaagggtgtctggactaccatatctagattcttgtacgatattcagccggagtttgtggactccaagtacttctgcgctgctgccaggaaaagaggctacatacacaatctaccacttgagagaaggtcgcctctcctccccttacctccgaagacaatatttgaagcatttcctcgtaccaagaggtggtggccttcatgggacccaaggcggcagttcaattgcctccagacttgtacgtctagcgcaaaactgttagagaggattcgtgtaacccttgcaaacagttcggatccaccacctccattagttcagaagtttgtgctggaggagtgtaggaaatggaatctggcttgggttggcctaaacaaggttgctcccctagagcctgatgagatggagttcctgcttggctttcccaaggatcacaccagaggtatcagcaggacagagaggtaccgatctcttggaaactcgtttcaggttgacactgttgcttaccatctctcagtcctcaaggataggtacccacaaggcatgaacgtgttgtctctattcactggcatcggaggagccgaggtggctctccataggctcggtatacgcatgaacacagtcgtttcagtagagaagtctgaggtgaacaggactattctgaagagctggtgggatcagacacagactggtaccttgattgagatcaatgatgtgcagacgctgacagctgataggatcgaggcatatattagacgaattggcggctttgatctcgtgataggtggaagcccatgcaacaatctcgctgggagcaaccgccaccacagagatggcttggagggcgaacattcttcattgttttaccattattttaggatcttggactccgtcaagtccatcatggagcgcctgtagtttttagaaacttttgatgttctggttcgtagaattgtagccgtctttccctgtgatcaaacttgtgaatgatttgaaggtcgactggtgtaatattcatgtcactctaatttaggctactttcgttaattacctcttgtgatcaatgcaaattgaaaggcaggtttcatttcttaagtttgtatttctcaatgcgagatctagtatctttgtcgaaaaaaaaaacctaaaa

SEQ ID NO: 680 - DNA, 7300 bp, Zea mays
aatacttgcttcacaaaccaacaagacccttaattttgttagttcaaaattgtattgttttatgatccggctctaacttgactcgatccttaaatttgctaggctaaattaaatggcccgttaccacccctagtcacaagccacctatattctccagctctctagatcctttacatgctgatgattggctgaaatcagtggataagatgcttaatattgctcaatgcaccgatcgatagaaggtgctctatgctttgggtcgtctcactggccccgttgctgattggtgggactcctacagtgcttcccatgccgctgccaacactattacgttggcagaattttctacacaattctggaactatcatattcatgcaggcttgatgaaaattaagaaggaattcttgtcacttaagcagggcaacatgtcagtcagtgaatatcgtgataaatttattcaactgtcaaggtacgctccatacaaggttgctgatgatgaaaggaagcaggagcatttcatggagggacttgttgggccactttagtatcagctggtatgtcacaccttcccatctttccacaggcttttggacaaggctatacacaaacgtgtttagatcagcgagatgaagaggaaggctatcacccaggggcaggggagcagtaacacccgtcctcgctatgtttgaccctagggtacacccactcgtcctggaggagggcaacgtcctgctcagtatacaccacatgcgactccacagaatccacatactcggtaggctgcccccactggcaccccggtgagacctgctggacagggtacagtcaccacttgcttcaagtgtggtgaggttgggcactacgccaatgtttgtccgaagaggatcccaaacacacccgctcgaagcaacatttagggcaagcaacaaactccagcttcaggcaagtgattcagtgttccgcccctgtgcagagagcaccgccgctgattcgtgttaagtgattgacgccctaaaaaggtgtcaacattcagcatttgataaaagtttgtaattttaacattacaatttcctaaagcttctaatgatctgctttatcaactttactgaattctatgaagctcaagcagttctaaacatagcctaaaaattaaatccatattcgagaaagagaggcatacatatgttccatttgcttctcaaaaatactcatgttccattttaagcttttaaccatagctttgattagaaaatcacatgaaatcttttggcgtaccttcattttctcgaaatcttactgtaagaaacattttacaacgaatgatatatgctgcataaaacgagaggaaaataaggggaaaaaaatcttgcagacgcggaaaagagctcctggaatcccggtccgggacggggacgggctcccaaagcggtgggaacgtcttttccctttcttctctcccgcgcggctgcgctcccccagaccactctcccccgtgctgtactgatgtggcctgtggcaatgcaggtgtccgtactctgcgcttaaatcctttccgggtggagttcttgcctttctcgccgcttccgactctgccatgccaccatagatccagctagggcgttcaatcctgtgcgagagtacgcgaaatcgccgccggattgatattgaccaggggtttctccgcccaactgaggtttcgctgccatttgcagggaccgtgctccagttcggcctttcgggggaaaaggcgagtcctcccatttcctcttttttagatgcatgagttgacgaacatttgggagaaacatcccctctttaatccgaaagattcgacaaagaacggctgttcttctgagcaggaatcgtatctgctgaatccccgggctccggggatggatcttgacatggacggctacgtagacccctacgaggaggccgcggccgagggcgactccgacgaccctgacgaggacgactcggatgcggagagcgactacgaggagaagtcgttcggcctcctcaagtccggcaagcaccgggtgcgcaacccggacggcaccttccgctgccccttctgcctcggcaagaagaagcagggttacaagatcaaggacctcctccagcatgccgacggcatcggcgtctccagcaagcaccgacgtcacggccgcgaacgcgcgaaccaccgcgcctttgcacgctttgtccgcaccgatccgtcctttgcggaagacctcgtcggtataactggcattcaaggtgccattacaactacccctgctaatgagaactacagcgccaatggcaacgggaaggccaaggctaatgtagatactgctggttccagttctgtggcggcaaaagtgggtccgccacaggaggttgagaggtttgcttggccgtgggcttgtgttcttgcagctggggcaggctttaatgctgaggactttgttggtagagtagcattgttcagttcggttgaggttgtgcctttgtttgtcgatgagatggaagtcacagaaaccttcgcaattgtgaggtttaccaatgattggagtggattcaatgatgcacttacgatagagaactatttcagcgtcaataagcttggtaagaaggaatttcagatgagagatagtggtcttggttccgtggagggagatggcgaaggcgatgtcaaggtttatgggtgggttgcccgagctgaggactacgatgcaacgactgtggtaggaagattcttgagaaagcacactgtcctgcaaacaatagacgaggtttccaagactgaattagagaaatcaggggagatggtggcgatactggcatcccagatcgaggaaaagaaccgatacttgcaggatttggagacaaagaagaatgcgacagaactctccatctcaaggcttgaggaggacaacaggaaacttcatgaggcatacaatgaaggtaatctgtgcaaattgcctcccttttcctttggttctacttatggtatagagttttcctgcatgcttgacatgtatgtctagagcatattcacatatgttctctgtcttgtactttacatttttatatttttcatggaagtcctgaaactatttgtttggtttttgttccctctttttatattgtacatggattatttggagaaaaagaaattatgaattggttagatgaatgcaggacttattgagataacattatgatgcatgaagttattccttgtcttatatgctttagcattatatttatcagtaagacaaaacaaaagacttacctgatgatagatagatactagacgctgcaatgaaggaaaataggtaatagaccaactctgaaacttcatattgatgtgaagttcctactgaaactgaaagtaaataaatcccttatgacctagtgacctcatctaaagttctaaacatttaaacaagcaaactcacagttactagagagtagagacctagagcagaagatcattgtccagctgaaagacatcagcagggacagcagcagctccccctccaactaattcacattcatcttggtccatatttgttgttgtttctggtggtggtggttcagctggttcagtagcatcttcatattgattactgtcatcttcaccaagaccttgagttgctgtgtttctggaaagtttccttttcctaacatacgttctttaaggctgagaagatgaaccagcacctacagcagtagccctagaaaaatttctgccccggacttgcacctaatttggtctggtcgaattgctccctaatcggacgatttaatcgctctagttggacgacgagaggacctgatcgaggcctcctcctagtcgaggacctgctggcgtctggcgaccagaccgaataactgagattagttggacgacttgaaaacagagtttttgagtgcttgaatttcttggctttacaaaatcgacaaagcaaattatttcggttggaagtcatttatcatgtaagttttatatcctcttcatttatcttataagttttatattctctcttcagaaatgcgcaatcttcatcgcagggctcgtgaaaatgcgctacggattttccaagagaatgaaaacttgaggattgacttagaaaataagaggagagaactgaacttacgagctaaggagcttgaaaaaatgtcagctgagaatgctaacgacaggaagacactcgatgatcagaagcagaaggtaagctaaacaactatacaagtgaaggactaagctatgcatatataactgcttctgaggtattatgtatatgatgctctgatatggatttatggggggtgtaaaaaacattcttttatttgagtgtctgaatgattaataagataaagaatttaggaagaatattctcatattgacgcaatacaaagataagtatatgcaaaatcgatccctttttagttaaaggaatttaattggttagcataaaataatatctaataaatagaaaatcgaatagtggataatccgttatgaaagaaatggaatacattctttgaagaatcaagattcgtaatcaatccttgtcttgtttgttggattaggtctaattttcttgaccaaacagcaagcatggaactttacaagaagaacttaaaagaaaagggtaattgaagtaactttgaatccacttttgttggggttcaaaaaacgaataaaaataaataaaaaaagtaaatttaaggaatagttccctttttgagggggcccctcgggggtcgtagaatgcttttcttcttctcttattccatatggaatacaatgagttcaaatttgctccaaaaagaggatgaaatccatcctattaaaaaagaaataatccgaatccgaaatagaaagattttttttttcaaattcaattctttatttatcttttattccaaaattctcccgaaaatccaatttcatttttcaatggggttagatgatctagttcttatgaattatgaattttccataacttaaacttaggtaagtgctttaccaacatatgtagtgtagtaaaaaaaatggaattgaaccccttcatgcttactataactagttatttcggttttctactggctgctttaactataaccccagctctatttattagcttgaacaagatacgtcttatttgaaatgaattgaatgaatagaagaatctttcttttggattcttggtattctagactcttttccacactaattaccaattcttttcttggtcattgagattcgtggatagtttagactattatttagagatagatcgtacctctttttttatcccctcgaacaaatcgaaatgattgaagtttttctatttggaatcgtcttaggcctaattcctattactttagcgggattattcgtgactgcgtatttgcaatacaggcgtggggatcagttggatctttgattgagtaatatttcttttttgattgacctcctctctggtctggaggaggtcaaattggagttgcaattctactttgttttttttaagttattttagtttcgacataagatatatggaatcacgctctgtaggatttgaacctacgacatcgggttttggagacccgcgttctaccaaactgaactaagagcgctttcaaaacaaaaagaaaaaagaaaatccttttctattccaaaacaaggacttcatttgctattgcaaagttagtttaaactgatttttcatcattactttcactttgacaagggacatattgctattaagtactttatcgtcttaattttatgcacttttcctatggacaccagttttctttctacaacctaattgtgtgcatataaaactaaaattaacagcctgagcatatcaatataacagcataagttcatgctgcagtatcttatacaattttttgtgtttctcttctgaaacatacagacaaagtatgataatagtgaacttgagctagctagcatagagcaacagagggctgatgcagatgttctgaagctattggctgaccaagaggtttgcactttccttaatgttgtttttttaatctttatctatattgtggagatgagaattgatacaccttaataacatcagagggaaaaggaagatgtacttgctagaatgcttcagctggaaaaagagctgcatgagaagcaacagcttgagctcgaagtagaacggttgaatggtacactccaagtgatgaaacatctagagggagacgatgacgggggagatatccatgaaaagatggagaagctgagtgaaagatttgagcgggaaaagaagcgcctggaggatttgagtggtgatctggtgacaaaagagcgtgaaagtaatgatgagctacaacaagcccgaaaagaattgataaaggtacggcccattttctctgttatagtttattttttagtaattaccatgcgtccaacaatctctcaaccaattgatgttcatagtatgatttaaaatggtgtaatgatttgcacaatgatcagggtttggaggaagagctaaatggacggacagctgttgggatcaaaagaatgggggaactcgatgaaaagcctttcctaaatgcatgtaagagaaaatatgggaacaatgaataccaggtcaaagcagcagagctggtcacaaattggcaggaggaactaaagaatccatcctggtatccttttaagatgattcatgttgacggagaggacaaggtacttgcttagtactgttcagctatgtgttattatctttagtgtttatagaacctacttgtatttgctcggaaatcacattcatcctcattcgtcgcaggaaattctggttgacgatgatacgaaactgaagtttctgtggattgagtttggcgatgacgtgtgtaatgcggtgaagacggcattgatggagataaacgagtataacccaagtgggaggtatgttgtgcccgagctgtggaacttcaggaaaggcaggaaggcgacgatgaaggaggtgctcaagtacctgttcagtcagatggacacgacgaccaagcgcaggaggggctgagtaggtgcccttggccatgccgtgaagcccagtcgtgtgctgctcgatcccgtagtggcagtctgtcttgtactgtgtagtgacatctgacgtaataatgttcaggcttgggtatggtttgagctaacgagccatatagtgtgcttggctaggctcgtttacgagctctttagctcgcgagtcaggtgagaacagaaaaaacaatatgtatataataattaatttctagttaattt

SEQ ID NO: 681 - DNA, 5771 bp, Zea mays
cacgacccaaactccatttctaacttgaagaacacctcccattctctctcacacatctcttgcctctcccattttaaatctttggagagaaatctttgagtgagttttgagagctacagtttttgtgcttcatctccaaatctctcttgctcttcttcattcgagctttggtactacatcgagttctttgtggattcattactcttagagcttctagctcctagatgactaggtgtctcttgtgagtctccaaatcttgtggaagaccacaagaaagtttgtattacccactcgtttgagcaaagattagtgtgtgagcttgacctttgtggtcggcaaagggaggattagggttgaaagagacccgactctttgtggacgcctcaacgaggaagtagggcaccttggtggtgtgatcgaacctcgggataaatcttgtgtctcttgtgttcttgttcattgtgcttatttgtgttcttcgttctctcaccattccgtgaaagatttgtttatatctttttggtgtgtggattttgagaagtgcccttctcagatctactactttgaaccctgtggatcatttagaacatctcattttcaaagttaactgggtgaatttcgagatcaattcagttttacccagtttgcttctagtttttgttgaaaaagctttaacttgtctattcacccctctaggcaactttcaataacatgtagaaatcaagcaacacacattagattcgtcatagtgaggtatgaaggaccaagataacatatctgaggataaataagcaagcatagatccaaggaaccgatcacaagcataaccatttatcacatcaacacttgaatcaaccatacttgaagaaatatcgtgggatctagcaagcaaccgaccagatccatgtcagaatctaagaagcaaatgatcggatctagcaatcaagcatacttgattaataggaagcctagatcaaaatcaagcaaacaaccaacaaaatatgggaggggaactcctaactgtagagagagttaaatcctcctactataatgatatatagctctcacaaggatcaccatggtgccaagtgctaactagtggccagcctctggctaccggtaaagctatctccaacagattattcataccatatcttatttcaaaatccactttataaacaatacgatctataatgtaaaacatttttttcacgatcatatacataatcttcttgatatagctcaacgctatagtcgcctttgcagatgttccaatatgactggtgtgtcgcagcagaatacgtaatcggtaatccaagtagcggccaacatcctgcatcccctgcctagacgctgtagccgatggccacaagcgagtcacacacgctgctgcaaaagaaatatagttgaaataggaaaatgtggacatatgagaatgacataattttaaaatatttaataacctaagaattgagaataagattacttttatttctttatatttaataatttgctaaatctgagttttttagtaaccagggtagatatgatagtaaagattgttcagctcgacgcaaacgacaaaaccatcttgaaaatggcagaaagaaaaaattcagaaggagccctcgaatcccggtcctaggaaccgtctgtcaacgcggtcggggtacttgagtgcctttttcttctctcacgtgcgcccctaaaccccagtgtgctgtgctaatggggatcgaacgccctgcgcttaaatcctcgggtagaactctcgcctcttccgactccgccataccaccaatagatccagctatggcggtgtagtcgaattcaatcctgtgcgagaaaacacgaaatcgccgctggctcgatattggccagggctttctccgcccaactgcatcttgcagcgactgtgctccagttcgggggaaaaaaaggtgagtccttcccatttcctctttttagattcctggatcgacgaacatttgggagaaatatcgcctctttgcttcgaaagatctgacaaagaacggctgttcttgtgtacgtacaggaaccgtatctgcttgaatccctgcgctccggggcggggatggatcttgacctggacgactacgtggacccctacgaggaggccgaggccgaggctgccgcggcggaggacggctccgacgaccccgacgaggacgactcggatgcggagagcgactacgaggaggagtcgtttggcctcctcaagtccggcaagcaccgggtgcgcaacccggacggcaccttccgctgccccttctgccccggcaagaagaagcaggggtacaagataaaggacctcctccagcacgccgacggcatcggcgtctccagcaagcaccgccgtcacggccgcgagcgcgcgaaccaccgcgccttcgcgcgctttgtccgcaccgagccgtcatttgcggaagacctcgtcggtatcactggcattcaaggtgccattaaacccacccctgctaatagagatggcagtaccaatggcgacgggaaggccaaggctaatgtagatactgctggatccagttctgtggcggcgaaagtgggtctgccgcgggaggttgagaggttttcttggccgtgggcttgtgtccttgcggctggggcagggttcaatactgaggactttgctggtagagtagccatgtttagttcggttgaggttgtgcctttgtttgtcgatgaggtcgaagtcgcagaaacctttgcagttgtgaggtttaccaatgattggagcggattcagcgacgctcttacgctggagaaccatttcagcatcaataagctagggaagaaggaatttgagatgagagataatggtataggttccgtggagggagatggtggcgaaggtgaggtcaaggtttatgggtgggttgcccgagctgaggattatgattcgccgagtgtggtagggagattcttgagaaagcacaccgtcctgaaaacaatagacgaggtttccaagactgaattagagaaatcaggggagatggtggcaatactggcatccaagatcgaggaaaagaaccgacacttgcaggatttggaaacaaagaagaatgcgacagaactctccatctcaaggcttgaggaggacaacaggaaactacatgaggcatataatgaaggtaatccgtgcaatttctctccctttcccttggttctacttgatggtttagagttttgcctgcatggttgacatgtctagccatttctatagcatatccatctatgttaactgtatcttgtaccttgcattttatatattttcatggaagttctaaaactgtttgtttgttttttgttccttctttatattatacatggattatttgaagaaaagaaatcacgggttggttagatgaacgcatgacttgttgagataatattatgtcttatgatgcatcatgcatgaagttattcatgccttatgtgctttagcattaatttttatcggtaaggcaagactaaagatttacctgatgggatgaacattggctacacgtacaaacaaatctctgacctctcccaatctttaattttgagcgctcaaatttttgactttacaaaatcaacaaagcaaacttctctattggaagtcatttatcttataaattatatattctattttcagaaatgcgcaatcttcatcgtagggctcgtgaaaatgctttgcggattttccaagagaatgaaaacttgaggattgacttagaaagtaagaagagagaactgaacttgcgagctaaggagcttgacaaaatatcaactgagaatgctaacgacaggaagacacttgataatgagaagcagaaggtaagctaaacaattttacaagtgaagcactaaagctatgcacatgcaaccttttctgaagtgtcatgtagatggtgctctaatatggatctatggtggtgtcaaacatttttttattttaagcgtttgactttatcctgaaaataaggacttcatagttatttgctattttttcaatggttgttaaaatgatatatcatcaatgctttcactttgataaggatgcattactattaagtactttatcgttttgattttatggcatttccccaaggatatcaggtttctttgtacaatctaattgcatgcccatagtttggtggacatatagaactaaaagtaacaactgagcatatcgttacgatagcataagtgcatactgcagtatcttatactttttttttgtttctcttctgaaatgtacaggcaaaatacgataacagtgaacttgagctagcaagtatagagcagcagagggctgatgcagatgttctgaagctattggctgaccaggaggtttgcacttagcattttttcttaatgatgttttgtacatgtttctctataatgtagagatgaaaacggatacaccttaataccaacagagggaaaaggaagatgtacttgctagaatgcttcaactagaaaaagagctgcatgagaagcagcagcttgagctcgaagtagaacggttgaatggtacactccaagtgatgaaacatttagagggagatgatgacgggggagatatccatgagaagatggagaagctgagcgaaagatttgagcgtgaaaagaagcgtctggaggaattgagtggggatctcgtgaggaaggagcgtgaaagtaatgatgagctacaagaagcccgaaaagaactgataaaggtgctgcctattttctctaccatgcacctaacaattcctctaccagttgatgctcataaaatgattttgaatgatgaaatgattttcacaatgagcagggtttggaggaagagctaaatggacggacagctatcggggtcaaaagaatgggggaactcgatgaaaagcctttccaaaatgcatgtaaaacaaaatacggaaaggatgagtacgagatcaaagcagcagagctagtcacaagttggcaggatgaactaaagaagccatcctggcatccttttaagatggttgaggttaacggagaaaataaggtacttgctcagttctgtccagctatgtgttatctttaatgcttatagaacctctattagtatttgtttggaaaaaaaaatcatatccaccctcattcgttgcaggaaattctggatgacgatgacacaaaactgaagttcctgtggatcgagtacggcgatgatgtgtgcaatgcggtgaagaccgcactgatggagattaacgagtataaccctagcgggaggtatgttgtgccggagctctggaactttaggaaaggccggaaggcgacggtgaaggaggtgctcaagtacctgttcagtcagatggacacgacgacgaagcgcaggaggggctgaggaggtgcctgatgccgagtagtgccttctatgttgttgcatcagtcgtgtgctgctcgatccccaagtggcagtctggcataggagatgcccctcttgtgtagtgaaatctggcacgataaagtgcccgcgatccaggcttgggtatgccttatgcatcatgttcatatgcttgtgcatgtggtgctgttgccgcaggcgccctagcctaacctgtatgattgttgagatgagtagtctttcttgctgctgttactcccttcgcccctcaatgtctctgaataaatcaattcctaaagttatcataaaatcgagcttttttaatcagactttttaaagtttaactgaacttatagaaaagagtcaggatttatga

SEQ ID NO: 682 - DNA, 7898 bp, Zea mays
cccacacgcggattcgagaacaagctctatgagcatcttcctccctattgactgtcaaaaaaaagacggtgatgcatgacaccacctcaccttatcgaatcatgtctcccttgttctgttctccaaccatgctgcacacctgccatttgtcatatactcatcaaaattcatataaaacccccaattgtatcaattccaatcccgtactagttaaaagataactatgtggagttgtcgcttcttcccgtaatgtagttaagttagagggccctggtgtggcgctccttcctgggtttgagccttggcattgcaccggtggtgcacccacctcatggctggtggcggtgcagatggttctgtgaccaccaatgaagcgagtgcacatgaggttcttgcctgctttccgtggtttggtgggtccctatcttaatacagtcaaatgtacatctctccttgatcaaatttccccgttaacccatgtggattatgtggtattgagtcgtttaaatccatagcaagtcaaaattcatcacaatccattccaatacactccaatccacatggaattggaataaccgaacaagaccttagttggaaattgagtcattccagtaatccagtctcttacatctgacacaaatatctttcctgagttgtgacaaccagtgttacccagacatctgcgttccttttttttgcggagccagaaaacttgtcggtttccaagtggtgtaccccccccccccccaatttttttttgtcaaactggacacctgcacccgtaccggacacaaatacccgcactagcatgtgtcccatgtgacactggtaaagtatttggcattttgtgttcccatttaccctcccataatggtaatgtcagttgttgcagaatcttacgttataagcaaatcatgtgaattggttaccgttttcctatacacatttcacatgaaccattgggattggtattgcaactatgataacagaggtatgctgagtgttcagtaaattcaagccatttttgaggatctattttgtttctccaagggtacactggtagattaattacataggctctggcattccagtggcttatattattattttttctttctattcttggaatggtcggatattaaactgcctaccttttagaatgtggtctcctgatgcaatattgtggctcatgtagttttaaatttaggaaagggaacactatttacaggctacaactccattttttaccactaatgatattttagaaaaaaaatgaaggtatttctaaatgatctattgtcttaaatattgtctttgttgctgcacttcacaggtctatatttttctagttactgatagcaagcattaacaatcttttgtcatttggtcagtatttattctgttccttaaatctagtcagtcaccctaaccttccttttttgttgattttgtgttttgtctgcatctctggccggtgtgtttttcttttctttctgttcacttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggatctctggatgcaacagaagaggtgcatcatggagtcgaaaaaggtgatggacatgttacccgcaagagaccaaggagatcagcggcctgttctgatttcaaagagaaatccatacgcttatccgaaaaaaaatctgttgtcatggtcaagaagaatcggatggaggaggaagaagtagatgctgtcaatctgacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaagaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttatctttggatctggtttcatgagagatgatgatggcagttgctgttctacagctgagtctgtgaaatcttcgtcttcctccagcaaagctgaccaactggatgcaggaatccctatttatttgagcccaatcaaagaatggattatagagtttggtggctcaatgatttgtataaccattcggactgatgtggcctggtaagtaccctcagctactttctttcagtacactgcttcattatgtggtcattaattgtgttcttaacagttgtgtcactgtatcctcttataccatttcagtgttattaaaactacgtttaaacgatgtttaaactacgtttaaacgtcaaaactctaattagatgttgaaaccacgttttagcgttttggcgttctaaactgtaaaacgtagtgttttatgcattttagaccattagctacttttgggcccagtctattagttactttcgaggtttaatccagctcatgggtgaagttttggtaagccactagcctctctattttggtatttaacttcatattattgtctgaaattataatgtattggtatttttcctatgttgtttaaaactacatttaaacaaagttcaaacttttaaaagtcaaaatttcacccatgagcgttccaacgttttatcgttttaataaccttgtaccatttgaacatcacttttagctcttttaatctttgctccattacaacttacatttagagttttatttcaggtacaagctacgccaaccaacaaaacaatatgctccatggtgtgagcctgtactgaaaacagcaaggcttgctgttagcatcattaccctgttgaaagagcagagtcgtgcctcaaagctttcttttgctgatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaacaaaagaaattgatgatgaacaagaagaaaatgaagatgaggatgctgaagatgaagggcagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtggctctagaagatgattcaggagacacagtcatttgttttgttgagtacatgttccagaaagttgatggttcaaaaatggttcatgggaggattctgcaaaaaggttcacagacaattcttggcaatgcggcaaatgagagggaggttttcttaactaatgactgcttagaattcaaattagatgacatcaaggaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattgaaaatattctcgaagaccagctttgtctacagaaaggttacatataatgtcaatgagtttttatacataagacctgatttttttgctgaagatgaggatcgtgcaaccttcaaggctggccgaaatgtgggtctaaagccctatgcagtttgtcaaatattgtccatccctgaaggggctggatctaaaaaactcaatccagcatcagcaaatatcagtgctagaagattttacagaccagatgacatttcatcagccaaagcctatgcatctgacatcagagaggtcatctttttttctatcttgtatgcttgatttatctactccataacttcattgttactttttctcaaacatgtgagcaaatcctagagtcctgagaatggtcattcttgtttctttcttcttaactttagtttgttcgattcaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcaggttagctgtactgtactgaagttgctattctgattcattgagtggcagttttgatagtttcctgaatatgtgttccatgtctggagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaataaaaaatttcctcattgttcaatgctgtaggtgtatcttttacaaaatgggcgattgaatacgaagagcctgctggtgaagcatttaataaaaatcatccagaggctgtggtctttgtagataactgcaatgtgattctaaagtaagtgcaaattgtttgatgccattattatattttttgttgttgaacagaaccaatatttttggtaatgcagggcaattatggataaatgtggggatactgatgattgtgtttcaacttctgaagctgctgaacaagcagcaaaacttccagaagtgaacattaataatcttccagtccctggcgaagttgaattcataaatggtggtcctccgtgtcaggtttgttattatctacagttctatgtataggccagaaaatcatcagtcacctgttcagttttgtcattcaaatgcttgaattgtttattcttttgttgtcagggattctctgggatgaatagattcaaccaaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtatttctgttaattcattatctgctaagacctatagcttacactttttatggtggtttaaatctgtatactcagaaattgtttgccatttggttaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacaattggggatctgcctaaagtgggaaatggtgccagcaaactcacgcttgaggtaactggtgcttcttgatcatctatttttttcttttctttgagctatatgctaaatgagctactgattatcttgtgcagtatggaggtgagcccgtgtcttggttccagaagaagataagagggaatatgatggtactgaatgatcacatatctaaggagatgaatgagctgaacctaataaggtgccaacacattccgaaacggccgggttgtgattggcatgacctaccggacgagaaggtaattttctgaaatctgttgttatattccttctgtccatggagcactgacccttggcccttgctattcttacaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcggcatgtgcttccaccctgatcaagacaggatcatcacagtccgggaatgtgctcggtcacaggtaagctggtctacatccatttccatctgcaaaatgacaatgacactcctgtctaatatgatccaatctttgccgtgcagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatgcactcctgaatgtatatgttagagaagtgtcgattgctgattgttaccctgattcagggtagcggttatatctaaaaacttgagaaaatctagtgtactctagttgtcatgtgttccattttgttggctctaaactttcaactagttttggtgattaatgacaacatgagattaaattaaattttgtagaggcatttaaattaggccactaatagtgactatttagtcgctcaatttttttgcccctaattatggaatttgtttttt

SEQ ID NO: 683 - DNA, 5725 bp, Zea mays
cccacacgcggattcgagaacaagctctatgagcatcttcctccctattgactgtcaaaaaaaagacggtgatgcatgacaccacctcaccttatcgaatcatgtctcccttgttctgttctccaaccatgctgcacacctgccatttgtcatatactcatcaaaattcatataaaacccccaattgtatcaattccaatcccgtactagttaaaagataactatgtggagttgtcgcttcttcccgtaatgtagttaagttagagggccctggtgtggcgctccttcctgggtttgagccttggcattgcaccggtggtgcacccacctcatggctggtggcggtgcagatggttctgtgaccaccaatgaagcgagtgcacatgaggttcttgcctgctttccgtggtttggtgggtccctatcttaatacagtcaaatgtacatctctccttgatcaaatttccccgttaacccatgtggattatgtggtattgagtcgtttaaatccatagcaagtcaaaattcatcacaatccattccaatacactccaatccacatggaattggaataaccgaacaagaccttagttggaaattgagtcattccagtaatccagtctcttacatctgacacaaatatctttcctgagttgtgacaaccagtgttacccagacatctgcgttccttttttttgcggagccagaaaacttgtcggtttccaagtggtgtaccccccccccccccaatttttttttgtcaaactggacacctgcacccgtaccggacacaaatacccgcactagcatgtgtcccatgtgacactggtaaagtatttggcattttgtgttcccatttaccctcccataatggtaatgtcagttgttgcagaatcttacgttataagcaaatcatgtgaattggttaccgttttcctatacacatttcacatgaaccattgggattggtattgcaactatgataacagaggtatgctgagtgttcagtaaattcaagccatttttgaggatctattttgtttctccaagggtacactggtagattaattacataggctctggcattccagtggcttatattattattttttctttctattcttggaatggtcggatattaaactgcctaccttttagaatgtggtctcctgatgcaatattgtggctcatgtagttttaaatttaggaaagggaacactatttacaggctacaactccattttttaccactaatgatattttagaaaaaaaatgaaggtatttctaaatgatctattgtcttaaatattgtctttgttgctgcacttcacaggtctatatttttctagttactgatagcaagcattaacaatcttttgtcatttggtcagtatttattctgttccttaaatctagtcagtcaccctaaccttccttttttgttgattttgtgttttgtctgcatctctggccggtgtgtttttcttttctttctgttcacttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggatctctggatgcaacagaagaggtgcatcatggagtcgaaaaaggtgatggacatgttacccgcaagagaccaaggagatcagcggcctgttctgatttcaaagagaaatccatacgcttatccgaaaaaaaatctgttgtcatggtcaagaagaatcggatggaggaggaagaagtagatgctgtcaatctgacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaagaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttatctttggatctggtttcatgagagatgatgatggcagttgctgttctacagctgagtctgtgaaatcttcgtcttcctccagcaaagctgaccaactggatgcaggaatccctatttatttgagcccaatcaaagaatggattatagagtttggtggctcaatgatttgtataaccattcggactgatgtggcctggtaagtaccctcagctactttctttcagtacactgcttcattatgtggtcattaattgtgttcttaacagttgtgtcactgtatcctcttataccatttcagtgttattaaaactacgtttaaacgatgtttaaactacgtttaaacgtcaaaactctaattagatgttgaaaccacgttttagcgttttggcgttctaaactgtaaaacgtagtgttttatgcattttagaccattagctacttttgggcccagtctattagttactttcgaggtttaatccagctcatgggtgaagttttggtaagccactagcctctctattttggtatttaacttcatattattgtctgaaattataatgtattggtatttttcctatgttgtttaaaactacatttaaacaaagttcaaacttttaaaagtcaaaatttcacccatgagcgttccaacgttttatcgttttaataaccttgtaccatttgaacatcacttttagctcttttaatctttgctccattacaacttacatttagagttttatttcaggtacaagctacgccaaccaacaaaacaatatgctccatggtgtgagcctgtactgaaaacagcaaggcttgctgttagcatcattaccctgttgaaagagcagagtcgtgcctcaaagctttcttttgctgatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaacaaaagaaattgatgatgaacaagaagaaaatgaagatgaggatgctgaagatgaagggcagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtggctctagaagatgattcaggagacacagtcatttgttttgttgagtacatgttccagaaagttgatggttcaaaaatggttcatgggaggattctgcaaaaaggttcacagacaattcttggcaatgcggcaaatgagagggaggttttcttaactaatgactgcttagaattcaaattagatgacatcaaggaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattgaaaatattctcgaagaccagctttgtctacagaaaggttacatataatgtcaatgagtttttatacataagacctgatttttttgctgaagatgaggatcgtgcaaccttcaaggctggccgaaatgtgggtctaaagccctatgcagtttgtcaaatattgtccatccctgaaggggctggatctaaaaaactcaatccagcatcagcaaatatcagtgctagaagattttacagaccagatgacatttcatcagccaaagcctatgcatctgacatcagagaggtcatctttttttctatcttgtatgcttgatttatctactccataacttcattgttactttttctcaaacatgtgagcaaatcctagagtcctgagaatggtcattcttgtttctttcttcttaactttagtttgttcgattcaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcaggttagctgtactgtactgaagttgctattctgattcattgagtggcagttttgatagtttcctgaatatgtgttccatgtctggagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaat

SEQ ID NO: 684 - DNA, 7512 bp, Zea mays
gtgcatttttagcccacatacggattcgaaaacaagcgctatgagcatcttcctccctattgactgtaaaaaaagactgggtgatgcatgacaccacctcaccttatcgaaccatgtctcccttgttctgttctccaaccatgctgcacacctgccatttgtcatatactcatcaaaattcatataaaacccccaatcgtatcaattccaatcacgtactagttaaaagataactatgtggatttgtcgcttcttcctgtaatgtagttaagttagagggccctggtgtggcgctcctgtcctgggtttgagccttggcattgcaccggtggtgcacccacctcatggctggtggcggtgcagatggttctgtgaccaccaattaagcaagtgtacatgaggttcttgcctgctttccgtggtttggtgggtccctatcttaatacagtcaaatgtacgtctctccttgatcaaattagggcttgtcagttccccgttaacccatgtgggtattgagtcggtttaaatccacagcaagtcaaaattcatcccaatccattccaatacactccaatccacatggaattggaataaccgaacaaggccttagttggatatggagtcatcccagtctcttacatctgacgcaaatatctttcctgagttgtgacaccagtgttacccagacatctgtgttccctttttttttgcggagccagaaaccttgtcggtttccaggtggtccccccccatttttttgtcaaactggacacctgcacccataccggacaccaatacccgcactagcacgtgtcccatgtgacactggtaaagtatttggcatttttgtgttcccatttacccgcccataatggtaatgtcagttgttgcagaatcttacgttataagcaaattatgtgaattggttaccgttttcctctacacatttcacatgaaccattgggattggtattgcaactatgataacagaggtatgctgagtgttcagtaaattcaagccatttttgaggatctattttgtttctccaagggtacactggtagattaattacataggctctggcattccagtggcttatattatttttttctttctattcttggaatggtcggatattaaagtgcctacctttttagaatgtggtcccctgatgcaatattgtggctcatgtagttttaaatttaggaaaggggacactatttacaggctacaactccattttttaccactaatgatattttagaaaaaaaatgaaggtatttctaaatgatcttttgtcttaaatattgtctttgttgctgcacttcacaggtctatatttttctagttactgatagcaagcattaacaatcttttgtcatttggtcagtatttattctgttccttaaatctagtcagtcaccctaaccttccttttttgttgaatttgtgttttgtctgcatctctggccggtgtgtttttcttttctttctgttcacttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggacctctggatgcaacagaagaggtgcatcatggagtcgaaaaaggtgatggacatgttacccgcaagagaccaaggagagcagcggcctgttctgatttcaaagagaaatccatacgcttatccgaaaaaaaatctgttgttatggtcaagaagaatcggatggaggaggaagaagtagatgctgtcaatcttacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaaaaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttgtctttggatctggtttcatgagagatgatgatggcagttgctgttctacagctgagtctgtgaaatcttcgtcttcctccagcaaagctgaccaactggatgcgggaatccctatttatctgagcccaatcaaagaatggattatagagtttggtggctcaatgatttgtataaccattcggactgatgtggcctggtaagtaccctcagctactttctttcagtacactgcttcattatgtggtcattaactgtgttcttaacagttgtgtcactgtatcctcttataccatttgaacatcacttttagctcttttaatctttgctccattacaacttacatttagagttttatttcaggtacaagctacgccaaccaacaaaacaatatgctccatggtgtgagcctgtactgaaaacagcaaggcttgctgttagcatcattaccctgttgaaagagcagagtcgtgcctcaaagctttcttttgcagatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaataaaagaaattgatgatgaacaagaagaaaatgaagatgaggatgctgaagatgaaggacagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtagctctagaagatgattcaggagacacagtcatgtgttttgttgagtacatgttccagaaagttgatggttcaaaaatggttcatgggaggattctgcaaaaaggttcacagacaattcttgacaatgcggcaaatgagagggaggttttcttaactaatgactgcttagaattcaaattagatgacatcaaagaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattaaaaatattctcgaagaccagctttgtctacagaaaggttacatataatgtcaatgagtttttatacataagccctgatttttttgctgaagatgaggatcgtgcaaccttcaaggctggccgaaatgtgggtctaaagccctatgcagtttgtcaaatattatccatccctgaaggggctggatctaaaaaactcaatccagcatcagcaaatatcagtgctagaagattttacagaccagatgacatttcatcagccaaagcctatgcttctgacatcagagaggtcatctttttttctatcttgtatgcttgatttatctactccataacttcattgttactttttctcaaacatgtgagcaaatcctagagtcctgagaatggtcattcttgtttctttcttgttaactttagtttgttcgattcaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcaggttagctgtactgtactgaagttgctattctgattcattgagtggcagttttgatagtttcctgaatgtgtgttccatgtctggagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaataaaaaatttcctcattgttcaatgctgtaggtgtatcttttacaaaatgggcgattgaatacgaagagcctgctggtgaagcatttaataaaaatcatccagaggctgtggtctttgtagataactgcaatgtgattctaaagtaagtgcaaattgtttgatgccattattatattttttgttgttgaacagaaccaatatttttggtaatgcagggcgattatggataaatgtggggatactgatgattgtgtttcaacttctgaagctgctgaacaagcagcaaaacttccagaagtgaacattaataatcttccagtccctggcgaagttgaattcataaatggtggtcctccgtgtcaggtttgttattatctacagttctatgtataggccagaaaatcatcagtcacctgttcagttttgtcattcaaatgcttgaattgtttattcttttgttgtcagggattctctgggatgaatagattcaaccaaagcccatggagtaaagttcagtgtgagatgattctagcattcctctcattcgctgagtatttccgtcccagattctttctgttagaaaatgttcggaactttgtttccttcaacaaagggcagaccttccgtttggcagttgcatctcttctggagatgggataccaggtatttctgttaattcattatctgctaagacctatagcttacactttttatggtggtttaaatctgtatactcagaaattgtttgccatttggttaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacagttggggatctgcctaaagtgggaaatggtgccagcaaactcacgcttgaggtaactggtgcttcttgatcatctattttttcttttctttgagctatatgctaaatgagctactgattatcttgtgcagtatggaggtgagcctgtgtcttggttccagaagaagataagagggaatatgatggtactgaatgatcacatatctaaggagatgaatgagctgaacctaataaggtgtcaacacattccgaaacggccgggttgtgattggcatgacctaccggacgagaaggtaattttctgaaatctgttgttatattccttctgtccatggagcactgacccttggcccttgctattcttacaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcggcatgtgcttccaccctgatcaagacaggatcatcacagtccgggaatgtgctcggtcacaggtaagctggtctacatccatttccatctgcaaaatgacaatgacactcctgtctaatatgatccaatctttgccgtgcagggctttcctgacagctatgaatttgcgggcaacatccagaacaagcaccggcagattggcaatgccgtgcccccgcctcttgcctatgcacttgggaggaagctgaaggaagccgttgacaagcgtcaggaagccagcgcaggcgtgcctgcaccatgagaagttttccttccatcaaaccatgacccatgaagctaagcgctgaggtcgtccttgaggaccagttaattttggttttatcagtcttaatggactcctgaatgtatatgttagagaagtgtcgattgctgattgttaccctgattcagggtagcggttatatctaaaaacttgagaaaatctagtgtactctagttgccatgtgttccattttgttggctctaaactttcaactagtgttggtgattaatgacaacatgagattaacttaaattttgtagaggcatttaaattatgccactaatagtgactatttagtcgctcaatttttttgcccctaattatggaatttatttttt

SEQ ID NO: 685 - DNA, 5340 bp, Zea mays
gtgcatttttagcccacatacggattcgaaaacaagcgctatgagcatcttcctccctattgactgtaaaaaaagactgggtgatgcatgacaccacctcaccttatcgaaccatgtctcccttgttctgttctccaaccatgctgcacacctgccatttgtcatatactcatcaaaattcatataaaacccccaatcgtatcaattccaatcacgtactagttaaaagataactatgtggatttgtcgcttcttcctgtaatgtagttaagttagagggccctggtgtggcgctcctgtcctgggtttgagccttggcattgcaccggtggtgcacccacctcatggctggtggcggtgcagatggttctgtgaccaccaattaagcaagtgtacatgaggttcttgcctgctttccgtggtttggtgggtccctatcttaatacagtcaaatgtacgtctctccttgatcaaattagggcttgtcagttccccgttaacccatgtgggtattgagtcggtttaaatccacagcaagtcaaaattcatcccaatccattccaatacactccaatccacatggaattggaataaccgaacaaggccttagttggatatggagtcatcccagtctcttacatctgacgcaaatatctttcctgagttgtgacaccagtgttacccagacatctgtgttccctttttttttgcggagccagaaaccttgtcggtttccaggtggtccccccccatttttttgtcaaactggacacctgcacccataccggacaccaatacccgcactagcacgtgtcccatgtgacactggtaaagtatttggcatttttgtgttcccatttacccgcccataatggtaatgtcagttgttgcagaatcttacgttataagcaaattatgtgaattggttaccgttttcctctacacatttcacatgaaccattgggattggtattgcaactatgataacagaggtatgctgagtgttcagtaaattcaagccatttttgaggatctattttgtttctccaagggtacactggtagattaattacataggctctggcattccagtggcttatattatttttttctttctattcttggaatggtcggatattaaagtgcctacctttttagaatgtggtcccctgatgcaatattgtggctcatgtagttttaaatttaggaaaggggacactatttacaggctacaactccattttttaccactaatgatattttagaaaaaaaatgaaggtatttctaaatgatcttttgtcttaaatattgtctttgttgctgcacttcacaggtctatatttttctagttactgatagcaagcattaacaatcttttgtcatttggtcagtatttattctgttccttaaatctagtcagtcaccctaaccttccttttttgttgaatttgtgttttgtctgcatctctggccggtgtgtttttcttttctttctgttcacttttcagtactgttattttaacttttgttcccctatataggcatatatctgattgatatgctgaccaatgatttttcaggaacaagaagatgcagagcaaagccacaaaagaaggaagaggaatccacagaaaacaacaagctggagaatggacctctggatgcaacagaagaggtgcatcatggagtcgaaaaaggtgatggacatgttacccgcaagagaccaaggagagcagcggcctgttctgatttcaaagagaaatccatacgcttatccgaaaaaaaatctgttgttatggtcaagaagaatcggatggaggaggaagaagtagatgctgtcaatcttacaaaacttggaccagaagatccaccaccttgccggaagttgatcgattttatcttgcatgatgcagaagggaacccacaaccctttgaaatgtcagaaattgatgacttctttataacagctcttatcatgcccatggatgatgatctagaaaaagagcgtgaaaaaggagtacgctgtgaaggatttgggcgaattgaggactggaatatttctggttatgatgaaggtactcctgtaatctgggtgtcaactgatgttgctgactatgaatgtgtgaaaccatcaaccaattacaaatcttattttgaccacttctatgagaaggctcaggtgtgtgttgaagttttcaaaaagcttgcaaaatcagttggtgggaatcctaaccagggcctggatgaattgcttgctagtgttgttcggtcaaccaatgccatgaaaggatatagtggaaccatgagcaaagatttggtgatatccattggagaatttgtatacaatcaacttgttggtttggatgagacatcaaacaatgatgatgaaaagtttgctaccctgccagttcttctttctctaagagaccagtgcagatctagggtggaactgaccaagttgccctctaacttctcgaacacaagtctgaaaattaaggactcagagtgtgatgagacagcagaagacgatgatgatgcaaaattagctagattacttcaacaagaagaagaatggaaaatgatgaagaaacagaggggtaggcgtggaacaccatcccagaaaaatgtctacataaaaatcagtgaagctgagattgccaatgactatccccttcctgcatactataagccatttagccaggaaatggatgaatacatatttgatagtgatgacagcatattttctgatgatgtgccagttaggatactcaataactggacactgtacaatgcagattccaggcttatatctttggaattgatccctatgaaatcaggggcagaaaatgatgtggttgtctttggatctggtttcatgagagatgatgatggcagttgctgttctacagctgagtctgtgaaatcttcgtcttcctccagcaaagctgaccaactggatgcgggaatccctatttatctgagcccaatcaaagaatggattatagagtttggtggctcaatgatttgtataaccattcggactgatgtggcctggtaagtaccctcagctactttctttcagtacactgcttcattatgtggtcattaactgtgttcttaacagttgtgtcactgtatcctcttataccatttgaacatcacttttagctcttttaatctttgctccattacaacttacatttagagttttatttcaggtacaagctacgccaaccaacaaaacaatatgctccatggtgtgagcctgtactgaaaacagcaaggcttgctgttagcatcattaccctgttgaaagagcagagtcgtgcctcaaagctttcttttgcagatgtcataagaaaagtagctgaatttgacaaaggaaaccctgcatttatatcttcaaacatcacacttgttgagagatatattgtggtgcatggacagataatactccagcagtttgcagattttccagatgagactatccgtcggagtgcatttgtcagtggtcttttattgaagatggaacagaggaggcatacaaagttagttatgaagaaaaaaactcaagtgatgaggggagagaatctgaatccaagtgcagcaatgggtccagcatcgaggaaaaaagcaatgcgtgcaacaacaaccaggctcatcaacagaatctggagtgattactatgcacatcatttccctgaagattccaaggagggagatggaaatgaaataaaagaaattgatgatgaacaagaagaaaatgaagatgaggatgctgaagatgaaggacagattgaagagaacatctcaaagactcctccatcaacacggtcccggaagttgctatcacaaacttgtaaggaaatcagatgggaaggtgaaacatctgggaaaacattgtctggagaaactctatataaatgtgcttatgttagggaactcagaatacctgttggtggaacagtagctctagaagatgattcaggagacacagtcatgtgttttgttgagtacatgttccagaaagttgatggttcaaaaatggttcatgggaggattctgcaaaaaggttcacagacaattcttgacaatgcggcaaatgagagggaggttttcttaactaatgactgcttagaattcaaattagatgacatcaaagaattggtaatggttgatatccaatcaaggccttggggtcacaagtacagaaaagagaattctgaagctgataaagttgagcaggtcaaagcagaagagagaaagaaaaagggccagcccatggtatatttctgcaaaagcttgtactggcctgagaagggtgccttctttgccctctcccgagataaaatgggtcttggtagtggtttatgtagttcttgtgataatatagagccagattctgatgaattaaaaatattctcgaagaccagctttgtctacagaaaggttacatataatgtcaatgagtttttatacataagccctgatttttttgctgaagatgaggatcgtgcaaccttcaaggctggccgaaatgtgggtctaaagccctatgcagtttgtcaaatattatccatccctgaaggggctggatctaaaaaactcaatccagcatcagcaaatatcagtgctagaagattttacagaccagatgacatttcatcagccaaagcctatgcttctgacatcagagaggtcatctttttttctatcttgtatgcttgatttatctactccataacttcattgttactttttctcaaacatgtgagcaaatcctagagtcctgagaatggtcattcttgtttctttcttgttaactttagtttgttcgattcaggtctactatagtgaggatgtaattgatgtgcctgtggatatgatagagggaaaatgtgaggttagaaagaagaacgatcttgcaagttcagaccttccagtgatgtttgaacatgtatttttctgtgaacttatatatgaccgtgccagtggagctctcaagcaggttagctgtactgtactgaagttgctattctgattcattgagtggcagttttgatagtttcctgaatgtgtgttccatgtctggagcagttgcctccaaatgttaggtttatgtctatggtgcaaaggacaagtgcgttgaaaaagaacaaaggaaagcagatctgtgagcctgatcaaatagattcaggtaaatggttggatgtgcctaaagagaaccgtctagctactcttgacatttttgctggctgtggaggtttatcagaagggctgcagcaagctggtatgtattgttaacactgatgctgtataccatgaacatgaccaacaaat

SEQ ID NO: 686 - DNA, 22879 bp, Zea mays
caatcaatcatcatcaacccgaatcacaagggacaagtcaaccttgtgttcgcagtcaggtgtcctgtttgcatgatctttgctatatgtaatgaacaaaatttcagatttctagtgaggaacaacagacaactgatgaaccagagttgcaatttcagaaaaaataggctctacttccatagtgcccctggtagccactaatacatgtgctttagctaaaattcactaatatctttgttgtgatgtgttcaacgactatttgtgtattttgaattgaatcttcctaatgctaatccatctcttatgctaggttggatagagcaacaatttctccttgttgcctagcaatgcaagcgatgctacaattatgaagagtcaattatgaagagtcgatgagcgactattcatgttgcctctacaatggaaaaagttcagaacatgcagcaacacaaaaccaagagaggtggtctagccattcaacatttgaaatttgtactcttattagattaataatggtcatctctatcatagctatttagtcggtgcaacactagtactactaattgtgtgtacttttatagtacgagtgttttagctaaaattcattattttttttgttgttgtgatgtgttcaacgactatttgtgtattttgaattgaatcttcctaatactaatccatctcttaggttaggcgggacagagtagcagttttccttgtttgcctagcaatgcaagcgatgttattgttgggggccttcctcttctaaaggtcgtcaaaaacgcggttaaccatttgctttcaatatactattagatattacaagagcttcgtcaccagaaaagcttcgacataacacaagaggagcgaagtgagcttcgtccaacatgcttcatcacggtgaaacagatatacaacatgaggagaaggtgttgctcaagttagtaaatacaaatgacgatactgctcttgtaacattttgcaaactctgtatgtaattgtcgagggcataaatgtaatagcacacaaacttttatagttgcctataaatagatgaacagtaccctcatactgttcacgttggattgtaattgctctcgtgttatcaccttcaaacaagccgaagatatcaatgtaatataaattctaataatatttatatgtttatcatggaataaatatattaatggataaaacaactcatgcatataaactcttatgaaccatgaagacgtgtcatcaatgatcttcgtctggagatcattatatccgagaggagataatatttcaaagacaaatgtccttaatgtttgataatcgtgttgacttgtttttgattcacaatatttgagaacgagacaatatataatatcagtttaaataatctctgatttttatattaaatttaaatttaaagaaaaaaagtcaaatgtttttataaatttgaacgggacaatatataatatcagtttacccttacttatttaagtcatcagtaaggtaaaagtgatctaggtctcccgcgccgccgccgccgccgcctaagctgcttccacctccgctttctgtgcagaggactcctcgccggagaatagccggcggcggctcgagacgaaactacggtgctcgtctcccgccgcccgccgcccttcactccccagcatacctagtccctactctaatccgtacagagcaacgcatcaagtgatggcgaagccggaggagaagctgcgctgcaccaaggaacccttcatcgaggacgtcggcacccggaggatgtaagcatgcggctcgcgtcccgtttaatgaatcgtagctcgacgattacacttactctgccgcttccctgttacgtttggttgcttttgatgtcagaaagagcatccggttcagcgtgctctcgggcagcgagattcgcaagtcagcggaggtacaggtctggaacaaccggatctatgaccgcgacatgacgccggttcccaatgggttgctcgacccgcgaatggtaatgccccgctcggtattgctgtttcgtcatgtgtattttcattgatgatttgaagatgggagttctaacataaacgtgcgtttgtggcatcgttcaagttgttgcaacttatttttcccgtgtcaaatttcagggaatcccgactaagagaggcaaatgcaatacctgccatggtgaatttagtgactgtccaggtcatttcggctacttgaagctcgcgcttccagtttttaacgtgggcttctttaactgtattctggacgtgttgaagtgcatctgcaaggtactgccatgaagaagtttacatcatgggtgggctgaacacttgaactctgacttgttaattattctcgttccctcatgcctttccagagctgtagtagagttcttcttatcgagaaagaccgcagggagtttctaaagaagatgagaaatcccagggcagatgcactacagaaaagtgctacaatgaaaaaagtgagggacaaatgcaaactatcctgctgcccccgttgtgattacagaaatggtaagccatcctatattgtccataataattttaccttgtaatgtcactactgatacctgactgttgtttgtaagctaacatttgcaagaaatcgctcaacagtcaactctttcctgtttttgttgtaaaaacaggtgtagttaaaaaaggcagagcgggcttgatagtagttcatgattgtagcaaagttttggatggacatacagaagaattgaagaatgcactacaaaataagaaagaaaaggtgtctgctagttcagttctagtgttagaccctgcaactgttctatctctattcagaagaatgattgatgaggttggtgccaattttcatccttcaagggtcttaagtgaagaaggaccatttgatgtgttctgctactccctgttttagtgctcaataacactaggacaggcaagtgagctggagaaaacattaaacctatctaacaagttgccccaagccacattggttgcctcacattagatgctattttgcaatttgaacttgtcgcagttttgttgacaaaagtttactcttttttcatttttctgcaggattgtgaattactaaaccttggtgataggccagagaaacttattgtgacagagattgcagtgccacctgttcctatacggccttctgttgttgttggtaatagtagaacaaggtttgccttctatttcttaagagctactatgtttatcctcattttagtttggtgattcagaataaccttgtgatcatgagttgccttgcttattgcagcaacgaagacagcattacagttattttgaagagcattgttaatacaaactccatccttaaggagacccttcatactgggggtccattcaccaagtgctttgtaagataacccaaagctcctcacttgtctgtttttacatgtgtctgaaaatttccattcatctgtcctttttttcatagatgtgctcttccatattttattttttggatcgtttttagttttatccacaaactatttgatgtcaagggcgtcgagcccccgactagccggaccgtggctacgcagctcgtagccatctgtcgtcctctccagtgaggttatccccccctcaaccgcaggtttaacacacacagagagagattaaggatataattcttccttaattgattgtcaagcgattacaagcatatatagccaatggcccaaccgaaatggagaaggctctccttgattctagggatttccaaaactctccttgattctagggattttcaaaacaacttactaatctaagtttatatctttagccactagaggctaacccaccacttcccttctttttgatttcccttctatttagatatgatatagacctaattcttatacaaagaaaactctttcgcttcactttgtctcactttctctagaatctctagaaaaaagaattgctctaccctttatttaatgatagtcagagactattaaataaaaaagaaaatacttactactaattggattagaacctgcccagcgtgatcagttgtgcgacgcacgttgcgggcgcgtctgtgcctggcatatgtgcgtccgcacatgacatctctccctgcttcgaagtccagctcgtcctcgagctgaaaggaagggaactgagcacagaggtcgtccagatcctcccatgtagccgaaacaggtggttcgccctgccattcaacgagcacctggcgcacttcccaggccagccgagtttgagtcaccctggcaggtgcaggcaccacaacactgtgcaggagcgaaggcaacaacggtggaacgaccggtgggttaccgacaaacttattgaggacgccgacatggaacacatcatgaaggcgagcgcagggaggaagctgtagctgcaccgccacctcgttgatgagctccgccacctggtacaacccgacatatcgcggtttgagcttccctgttgccgagtgtgggagggatgctgctgcctgctgccgaaggcgaagaagagcccaatcgccgacctggaaggacatcggcctgtgctggtcgtagacgcgcttctggactgcctgtgcctgttcaaggcgatagcggatgtcgtcgaggaaggcaacgcgctcctccatctcatgggcgatcgctgtgacgcgggtctcgccgcgctcataagagcggatggtcagggggtcccgaccatagaccacacgaaacggagtttcgcagagcgatgattgataggtggtgttgtaggtgtactccgcccatggcagccaacagagccactgccgggggcggtcgccggtgaagcagcgcaaatacatgacgatgacctggttggcggcctcggtctgcgggtgaaaggcgaacgacttgtagagcttcgtaccagtgagccgcatgagttcctgccagaacgtcgaggtgaacactggatcgcggtccgagacgatggaatgtggaacaccatggaggcgaacggtgtcgacgaagaaggcgtgagcgatggactcggtgtaggggtgcgccaaggggatgaaatgacagtacttgctgaagcgatccacgacggagaggatgaccgtcttgccttgcaccttgggcagcgccgcgatgaagtcgatgccgatgtcagcccacacagcagacggaaccggcagtggcagcagcagaccgactggcctgaggtggtcgaacttgtactgttgataggtgacgcatgccttcatgaaatcctgcaccaagcgacacatgttgggaaaatgaaaatcccgccggagcctgtggagggtgcggtggatgccctcgtgaccgtcgttgtgggccgcgaccaagacctcctgcagcagcggcgacgccgggggaatgtacagacagtcgtcaaaggcgaccatgccgtccaccggcgcccatggagcggcacgggtgccagcccgcacctcatcgtggatggcgaccagggtcggatcagtggcctgggcgtggcagaggcgcttgatgaagtcaaagcggggcgctgaaatagccatcacctcccctacgtcattgtcgagacgggagagggcgtcagtgacgacgttcgtggcgctcgaccggtactccactgagaaatcgaagcccaggagcttgccgacccagtggtgctgagggatcgtggcgaggcgctgatcgaggaagatgagcttgcgctgatcgaggacgggagtgggcgtcggcgacgacgttcaggctgtagtggttggttttgacgatgaagcgccgcccccagagatacgggcgctagtgccttaccgcatggacgaggccgatgagctcgcgctcgtaggcggctagcgagcggtggcgcaacgccacaagcctgctgaagaaggcgaccagatggccctcctggaccaggaccgcgccgaagccgaacgacgacgtgtcgcactcgacggtgaacaacttggcgaagtcgggcatggcgaggacgggggcggacgtgatggcggccttgagcgctgtgaatgccttggtcgtcgcgttgtcctaggtgaatccctcctcgagtagggccgttagtggtgcagcgatcgccccgtagttgtggacgaacttgcggtagtacccgtcgaggtcgaggaaatcgagcacggtccggggcgaacgtggagccagccaatcatggatcgcctgcaccttggccgggtccatggccacgcccgccgcagatatgacatggccgaggtaggcgacggtggaagcaccaaaagagcacttggtgcgcttgatgaagagttggtggcggcgtagttcgtcgaggacgttccggaggtggcgaagatgatcaacccacgtcttgctgtaaatcagaatatcgtcaaaaaataccaggacgaaacgacgcaggaacgggcggagcacgtcgttcatcaaggcctggaatgtcgccggggcgttgcacagctcgaacgccatcacaggaactcgtacaggccgtcgtgggtgcagaacgccttcttgtgcacatcctccgggcgcatgcgcacctggtggtacccggaccggaggtccagtttggtgaagaacttggcgccatggagcttgtcgaggagctcatcgaccaccgggatcgggaaagcattcttgacggtgagcgcgttcagcgctcggtagtcgacacagaagcgccacaaaccatcaggcttcttgacggggaggacgagcgacgagaacgctgagtcgctgcggcggacgatcccttgatcaatcatggctgcacactgccgctccaactcgtccttgtgcgccgcggggtaccggtaagggcggacgataaccgtctgggcgtcgggctagagaataatacgacggtcgtgcgcacacttgggggcagaccgacggggttcgcgaagagcccaaaaaacaaaagcagcagcgcctccaagaggggaccaacctctgttgttgcgcccagggccggcacagaggggctggccacgccggtgcaggagacggggcgcccctggcgctggaaggtcatgcgccggcggctgaggtcccaaacaatgggcccaacttgccgagccatcgggtgccgaggacgacgtcgtacccggcaggtggcatgacgttgaggttggccggaaacgaatcaccgtcgatgagcaggggcgcgtcgcggatgacgccgacgcaggtgacccgctcgccattggcgaccaaggctatgaggcgggggcgttggcggaggggtagaccggagcgccgcgccgcctcccccgagatgaagttgtgcgtactgccggagtcgaggagggcgacgagggacgcgacgcctagtgccacgacgatctgcatggtgcccgccatgggaaccatagccatggcctgcaggaaaaaacagggcgcctcagcgttgtgctccgcgttgccagcggcgttcgcgacatcctcgatctccacgccttcaaggaagaagatgcgccgacagaacctaatatggacacgagtatatttttcattgcaattaaaacagaggccccgacggcgtcgttctgccatctcgtccggggtgaggcgcctctggttgccctcgccgcatccctgctggccggccaccgggaggggcagggagcgccattggctgctgggcgtcaggagcgctggccggggcgcgggaacgggtaggagtccgcgcgcgagcgcccgagggggaggctgcaccgggcggtcgatctccatcaactccacttggcgcgccaggcacatggcggccgtgagcgtctccgggttgtggatgcggacgacgtggctgagcggtgacaggagtccaccggtgaagagttggacgcgctgcgcctcatcaagacgacccgcgcgaggtaggagggcctggaagcgattggagtactccacggtccctgtacgccgacactcggtgagctcgaacagcggggccgagcggaggggaggcccaaaccgcaagttcaggagctccttgaatcgcccgtcctcctggagttggatgtaccagagttgcgcgacgacctccaaattgtacgaggccatccacacgcgcttctctgccaaggtgcgctgttggcgaaaataggattcacacttgttgatgaagagcatcggtcttggcgtcgtagcggggaaaatccaaattttggaattttgggggacgatcaagatcgcgcggcccctccgggcggctgcttgcgccgctgttcgacaacgaggccgacttctccttcatagcctccatgtcggccttcatggttttcatctccgtggtgatggatttcaacatctccatcacatcggcgatggtgggatcgctcatgtctgctggctgcggtgcaaaagcgttggaggactgcggcgatggtggagggctagggtggtgggcggaggctgtggaagaatgggtgggagcgggtgggagaggaccgacgtgaccgtgatactaggttgtcaagggcgtcgaacccctgactagccggaccgtggctacgcagctcgtagccgtcggcggtcctctccgatgaggttatccccctcaaccgcaggtttaacagagagagagaataaggatataattcttccttaattgattgtcaagtgattacaagcatatatagccaatggcccaaccgaaatggagaaggctctccttgattctagggatttccaaaacaactctccttgattctagggatttccaaaacaacttactaatcttagtttctatctttagccactagaggctaacccatgcagcgcctacccaacgcgctcagccgcgcggcgcacgtcgcgggcgcgtccgcgcctggcatatgtgcgtccgcacatgacatttgacttttggttgcttgtaaagtgctattcctggaaataagttgtacagtacatacatgaagttatggcatttatgattagcacatgtgattattaactagaaatctgaagtccaagttttctaatactgcgtttggatggtggtattgaggcccagattttggaattggaattggtattggtaaagtcgaattccagcgtttggatgttcacggaattcggaactggaaatccatcccaattcccctggtattcaactacacctgcaccccctccccttcaataccgagcccccacctcagttttgatcagaattcaactacaccggcatctaaacaacaacattggtattgcagatcaattccatttctcctcagatttggtattcctagaccaattcaattccaccacgtgaatgcctacatccaaacggagtataaatatattaacgagctgaaataataaattggaaacttgtgcaaatattggacaataacctgtagctacttgcctacttcaaacttcacactatttctggctacattaaacttagttgatgattctgatctttaaaatggcgggggtcatattttcagatgcttcattttcaatctggataattgattcatcagactgtaacttttgtttatgtccttagctaacttttcactcttctaggattgctggcaataccttcaacttcaagttgttgaatatgtgaatagtgatgccccttctcttcctgagtcacaacatcggggccttgttcaacgactcaaagggaagactggacgatttcgtggcaatttgtccggaaaacgtactgagtacacaggaagaaccgtcatatctcctgatccaaatttgaaaataacagaggtacctgttcatgttcaattgtttccttatttctcactttccaattgccttttcatgtcacaatttattagtacttcaggtggctattcctgtgttgatggctcgagtcttgacttatcctgaaagggtttcaaactataacattgagaagctgagacaatgtatacgaaatggaccattcaaatatccaggggctaattttgttacacaacctgatggcatgaagcagtaagttctaacttgacgaacttctgaattgttatccagctcagcttcttctatcatccttatgccttttcaggagcttaaagtatggtgatagaaggattactgctcgggatttaaagtgtggatgtatagttgaaagacatttagaagatggagatgttgtcctctttaatagacagccgagcctgcatagaatgtcaattatgtgtcacagggtatcaatgtctccttatttcataaaagtatacatcaagcatttcttcacctttgaatatttgcttttatacttgagcacaggcaaggataatgccatggagaacactcagatttaatgagtctgtttgcaacccttacaatgctgattttgacggagatgaaatgaatttgcatgtccctcagacagaggaagctcgcactgaagcgcttatgctcatgggggtagcatttgctttccttctttcttaagttgaacaaactcacttttatgtgctaacacctagcacatctttgatagctgatattttttatttttatttcttttacaggttcagaataatttatgtactcctaagaatggtgagatactggttgcttccacgcaagacttcttgacctcatctttcctagttacaagaaaagatactttctatgatagatcttcctttactcttttgtgctcataccttggtgatggaatggagaacattgatttgccaacaccagccttgattaaagtaagattttcatactgagttttttgtttggtcatatctggaatgttatgctaattcttcttctagggatgcctatagttagaatagtcgataacttgatatcattttactatgataattaaggtgcttactattatgttttgtaaatcaaatttcagcgtttgcatataataagaaaacatatcaaaatgcattttgtttatttcctaaatgaaatctatgcacttgcctttactcttttcattagcatgcatcttagtacacactcttgtttatactgagatacccatatcttatgtgtattctatttttgcagcctgttgagctttggactggtaaacaactatttagtgtgttagtccgacctaatgcgcacacaaaggtgtttctgaatcttgctgttcaagaaaaaatttattcaaagaaaaagggaaaaaaagaggggggagaggaggtaaaggaaacaatgtgtggaagggaaacaatgtgtcccaatgatggttatgtttatttccgaaatagtgaactgttatctggacaagtagggaaggccactttaggtaattattagaaagaatatgcaattttatcagttattactaaatattctgttccttagttcctataatttatgggcatctgttatttatgttttacatgaagatttgggaacaataaaaaatgatgaagcctttgtcttcaggtaatgggaacaaggatggcctttactctgttcttttaagagattataattctcatgctgcagcaagctgtatgaatcgtttggcaaaatttaggtgagacacattccatgctctgtgtaatcacatcattgatgttactttatgtgaaaggtggttcttttatcgataaactcctccatgtgatattcttgggattccttatatgccactgatgtcttgtggcatgtaacacattggaaatgtacaatgtaaggttgttctatagatgcattaggagatagagaatacacgctacatcagatatcgtcttttgtaggagctgtcacctaccatggaaatacctttgtaagccttaaacctagcagtctaattaattgtctcttggtctcaacaacatagatgaaacacatttcagttacctttgctgctcttttttctctcgaaatgcgcaggagaactgcgccccattatatattaagaagaatatagaaaaaggtctaaagaagaccacgaacaaacagcttccttacggaggccagtagctagcatacataaaagaatccatcagagaaaacaaaagaacaccctagaaatcagctaatggggcagccagagaacataggccttttgccccagctgtttcccaacgacttctctccccatcagcagatgccaggattgaggttagacttggagtcctcccatcgaagacacatctatttcgatgattctatattgtccatgcacctaggatgataagggagtcaaggcctttttagtaaggccattgacaacatctgaatcctcttcccaccatctcatgaggaggtgacagccggctgaggggcaagggagtgcagcccaaattttctcagaagctgatactagaaaattcttgaaaaagaacaagccacaagatggtccaaagtttctgcctcttggtcacataaaggacatttgtcagggtggtttagacctcttttagctaatctatcaactgtccagcatttattttgagcaacaagccagatgaaaaaacgacactttagcggggcccgtgttttccacactcatttatagtgcccaaaagaaactaatcccgggaacaatccactataagcagatttttcagagtaaattccatctggagcaatgctgaaaatatgcctgtcttcagttccaggttgcagctcaaaaactgaagaaatcccagagctgtaggtaatcagtcaatacaccaactgagggagccccttttatatcaacaatccaattcctatttgtaattgcttcttgcacagtcctgctattaacaatccgctttggaattacagcaaagagtcttggagcaaggtctgctattcttttaccgtgtaaccacttgtctttccagaatttggtattggtcccatccccaacttcagtgaacacaacctcatcaaaggaagctctagccttttttggaacatgaatggggagaccaaaccagggccttgaggggtcggttttgagcagccaaagccatctcattcggagggcccaacaaagttctggtaaactggagatacccagccctccaagctgaagggggaggcgaacctttccccatgccacaaggcagtgaccaccttttgcctcttttcggcctcttcaaagaaatcctttttctaattatgtcaatggcatctaaaccccattgggtgatgtccactgccattgccagataaacagtcatgctggtaaggacgtgctggacttggacccttctccctgctcgtgttaataagtctgccttccaatttggaagctgatcagcaattctgtcaacaattggctggaactgctgcctagataacttgtgtaaggatagaggaagtcccaaatagcgacaatgaaaggaagatatttcacaaggcagcagcacatgagtttccaacatgtcctcctcagagcaatggacccagcaagttcctgcacttgcatgcattggcttcctctgtggtgtgggaagctattaactgatggtaagcgccacacttgttagtgtcttgaggagccaagaaatttctgtggcatgaactctcaattcacgtcgatacattttatcccatttttgtattcaagagagctaataggtttcttaggccatagttattaaggtgtcgcctaagcgtcactaaagcgatgcttaggcggtaaggcgagcttgacacgcaaggcgtcccatcgccttgtcaactagagtaaggcacgggaaggcaggaggaggtgcacaacacgcagagcgcggcggaggtcgtggcggcagcgcacagggctcctgctatcggaggagggagagctgcggtggaggaaccgagggagaggggagctgcgggggaagtgagagagagagagaggagagctgcggggtgagggagagaggcagttctggtgctggcgctaggttgctggcggctgatgtgagttttatcctaaaactgtattgggctgagttaaaactgtgttgggctgagctgggcttattgtgagcttctttctttttcttttttcctgcttctactaggctgaaattgggcctactagaccttataaaagtgctagcttgcttattaactttaaattaatgatatataaataatattttgatctattttttatatttatctatataactaaggtgaagcctcgccttacgctttatcacctaaaagataaaaagggggtcagtcgccttactgccttgataactatggcttaggccaagttagctaaccctacactgtatcggcctcactgcatgttatttataaacatcacatatgtaccacattgtttcaaattagtgcatggaaactgtattctggtctgaaggtgcttttccccctctgcagtgcaagatttatagggaaccatggtttttccattggtgtggacgatgtccaaccaggagaacatctaaatcggcaaaagaaaaaggaaatagacggagggtacaaaaaatgccatgatcttatttctttgtttgcgaaaggcgcgctcgcattgcatcctggttgcaacgcagcccaaacgctggagcataacatcactggtgtgttaaatgaaatcagatcaattgctggaaatgtaagtttgcacatagtttcataacatccctgatctgattgatcctctttgctctgtttgtttttacagttaggtagaacataattgtcattcataatcataagtgttctcatgcctatcatgttggatattatttttgaaatgcgtctctgtagtgttacttgagtaaggttccttgttgagacattattattgcgttagtttgtagcatcacaattcagtgaacagggttgatgtagtgattttgccaggtgactagtgactgtgtccactctgaatttggtatgctttttagcggatcgttgaatttcttgtgatgaaacttttttcaggtgtgcatggatacgcttcactggaggaacagcccattgattatgtctcagtgtggttccaaaggttctccaatcaatatcagtcagatggttgcatgtgttggacagcaatcagttggagggcgtcgtgccccagatggttttctaaacagaactcttcctcactttcctataaattcaaagacccctgcagtaagtgacaaaaagaaacatggcttgctaatttgtgcatagatatttctagttctatttgaatgaataacaacaacaaagccttttaatcccaagcaagttagggtagcctagagttgaaacccaacagaagctacaagtcaaggttcaagcgcgtagatagctgttttctatccacttctatttaaggctaaatctttcttattcaaggctaagtttttggatatattccattctttcaagtcttctttaaccgtttgttcctgaaagcagatgaactgctgaatattgattgatgatatgagggttaaaggttacatatatatagggaggagatctgtgtggtttatggaaacagaaccaatcatgatctcctcacatctctagctatagaaacataaccaatcagggtctctagctatagaaacataaccaatcaggatcccctcatatctctacatatctctagctgtcctaatcagaaccaatcagcagatggctgtccttatgtggctgatagggacagagatggcgccagcctgtagggactgcctgcatggcgcagtcaagactgctaacacccccccgcagtcggagcgtcgaaagcctggacgttcagactggaccggaactcagtgaacaatgaagatggcaggcctttggtgaagatgtcggcgtactgggaagtggtagggacgtgaagaacacgaatagtaccaagagcaaccccgctcgcggacaaagtgaagatcaatctcaatgtgcttcgtgcactgatgctgaaccggattagaggacatgtagacagtgctgatgttgtcacagtaaaccaatgcagcgcgctgcagaggagcatgcagctctagaagaagctggcgcaaccaggtagcttcggcaacagcgttagcgacagcacgatattcagcctcggcactggagcgggagacagtgttctgtcgcttggaagaccaggagataagactgtctcctaggaacacagcgtagcccgaggtagacctgcgtgtatctggacaaccagcccaatcagcatcagagtagaccaccaactcagtttgcgcagaggggcgaagtaacaatccgaggtggagagtgccacgaacataacgaagaatccgtttcagagcagcgaggtggggctcgcggggatcatgcatatgaaggcagacctgctgaacagcataagcaatatctggtcgagtgaaagtcaggtactggagagcccctgccaaactgcgaaaatccgtaggatcagtgactggagtaccatctgtgcctgagagcttgggatttacatcgacaggagtggagcaaggcttgcattcggccatgccagcgcgagtcagaatgtcaaccatgtactgccgctgagagaggaacaggccactcggagtgcgctgaacctgcatccccaaaaagtgatgaagctcgccgagatccttcatggaaaactcctgctgaagagttccaatgatgcgccgtaggagggctgtggatgaggctgtgagcacaatgtcatcaacatagagcaggagatacaccaagtcagtgccgcgacagtagacaaacagagatgtgtcagatttagcctccacaaaaccaagtgagagcagaaacgaggcaaaccggctgtaccaggcgcggggcgcctgtttgagaccatataaagaacgattcaaccggcagacgaagtcggggtgagctgaatctgtaaaaccagaaggctgggagcaatatactgtttctgacagagtgccatgaagaaatgcattcttgacgtcgagctgatgaacaggccagttgcgagacagtgcaagagtcaacacagtgcgcactgtagcaggcttcacaaccggactgaaggtctcgtcaaaatcaatgccaggacgctgtgagaaacctcgaagaacccaacgagccttgtacctctcaagagaaccatcagcatggaacttgtgcttgaaaacccacttgccggagacaatattggcagccggaggacgaggaacaagatcccaagtgttgttccccaagagagccgagaactcctcttccatggcctggcgccagtgaggatcagcaagagcagctcgataggtccgtggcacaggtgagagttgtgctgcgtgaaatagagctggctgtcgaaaccccagttttgctcgagtagtcatgcggtgatggttgacgaccgggggaacaggaacagcgccgggtgggagctgagatgcggctgctgaaggcgaagaagcagcaacaggcgtcggtgcagcgggtgcagcaacgggcgttgttgcagcaggcgcctgcggtgaaggagtagcatcagcagtcggagctggcgcagaacgacgagtgtagacgaatccgtcgaagcgtcgagggccgggacccggctgggtatccggggcgcggtcggcaacgactgcaggtgcagcgtcgtttgtccgggcggagccaggatcaggtgtaggtgcggcggtaggcaggggcagcagctggtcgttggagcacggactgctgactgctgctacaggggccgcacgtggctgtgcgggagcgtctgttatacctgcaggaaggagacagaaacgtgctgatccaataggagcaggcacggcagggtgagaatctaagagaaactcgaaatcctcggcagtgggtgtggatgactgttcggcaaagggaaaagaagtctcatcaaagactatgtgccgagatatgatgatcttgttggagtgaatatcgaggcatcgatatcctttgtgatgatcagaataaccaaggaagacacacaaaacagaacgaggagcaagtttgtggggggaagtggctaacaagttaggatagcatttgcaaccaaagacacgaagatgatcatagactggagctgtaccgaagagggcttggtgaggggtggaaaaacgaagtgtcttggttggcaaaatgttgagaagacgagctgcgccgtttggctgcgaacgcccgcccttcttcccagcacgtttgccccgtgactgctggtgcggctgctgcttcggcttggagttgttcggcgacgccttaggtggtccggaggcgagcagagcggtggccgatgtcgaggagtgatgtgccaaggtaagttcctcgaggagaagatcgtttcgtacctccaagaaggtaggaagaggccgcccgcgtcgaagatgaagaccgatgctgctgaaacgttcgttgaggccgcggatgacgttgaggacgagagtgcggtcgggaacgggctcaccaagatcaccgagggcatcggccatccctttgaacttgcgacagtagtcggtgatggagagatcgccttggcggaagttgcgaaactccgcgtcgaggaagagagctcgagtctcccggttcccgaggaactgggattctatggcgagccacgcggcgcgggcggagacatcgcgaatgagaacggcgtcggctagctcggtggtgatggtgccgacgatccaagacttgacgacgcaatccatccgcacccaatctggagagaagggtgcgtagtcgtcggtgagaacgtggccttccagggagtacttgccgacggcgagcaggaaggcgtcgcgccaccgggtgtagagggtggacgacacgtcgaggaggacgggaatgatagccctgatgttctgaactgcaaccgcctgagcgtgcagattgatgagcgcagcggcttcatgaaggagaagagcttcacgcgtgcgagcgtcaggagcgtcgtcacgaatggtggaggcgtcgtcgttgttgacctcctcgtccaaaggatcagcagcggcgcgggcctgggcggcccgggcgagagcgtcgcggatgcgggcggcggccgcgtcgcgctccttggtggcctcagccgcctcgcgttcagcattgcgggcacgcgcaagggcgagctcgcgagtttgaagacgagcagccctctcctgctgcgcgcgcagagcagcctctgccgcagcagcgtcgtcgactctgggagaagggggctggtggctagccatggacggcgcgcaggagcagcagccgtagcagcgtcgggtgggcgcgctagacagcggaaggtgagtagaaatgaacctagactcgtgataccatgaaagcagatgaactgctgaatattgattgatgatatgagggttaaaggttacatatatatagggaggagatctgtgtggtttatggaaacagaaccaatcatgatctcctcacatctctagctatagaaacataaccaatcagggtctctagctatagaaacataaccaatcaggatcccctcatatctctacatatctctagctgtcctaatcagaaccaatcagcagatggctgtccttatgtggctgatagggacagagatggcgccagcctgtagggactgcctgcatggcgcagtcaagactgctaacagttcccatgtcaacttcggtctttgcctgcctctctttacattactttcgcgtcttaggatcccactacgcacttgtgcctttggaggtctttgttggacatgtccaaaccatcttaaccattgttggacaagcttttctttaattagtggtatccctagcctatcacgtatatcatcattccgaacttgatcccttgtatggccacaaatccaacgtaacacacatttccatagcacttaaaatagttggttgtcaagagtcaagctcagctcaccagctccaacaatggcagcctttaccatcagacaggaaagaatgcttttggataaacaaattctgcaaatttgttaccatcattgggctgaatgactgcatatagcacatcttctacagcgcttatcgaaaagtgcagatataatagtagctttagttttcgtttctcaattcccatgtaccacagccatcaaacttttctgagtgattgcatgattgttggtttgttgaatctggtggttttaccacagtaaacgatagagaaactggagcttttgggaagttatgctttttaaaataataccacccttctgtatttctattttctgacatcaatgaatctgccatttttactttataatttcaaaatgaagtagatatttaaatttgttaacacaaaaacattctgataaggttttgtcttccatttgcaggctaaaggttttgttgctaattcattctatactggtttgactgctactgagtttttcttccacacaatgggtggacgagaaggtcttgttgacacggcggtatgcctaaatttaaacatgtttctttcttgcatcaatgtttttgagtcgtgaagtcgagtcgagtcgagtcgtgtagctactgactagtagactagtgatgactaggatagactactcgtgactagttgaatataagtcgatgattacatttttataattttctatatatgctaatactaaaaacacactgaaacactaaaaaacacctcgtttagtgtatcttcatcaatctccatcttctacaatacatcattaaatattgaacagtcttgtagcaagtctcctattgtgctctctgatttcaaagaacttgtttgcattcaaaaacagtgcatgcctcatacagattggtattcatctgattgtcccacctcttatcttatcaacaatagaaattacttcatccattaatcgctgtgttccaaagcttccttgatgctcttttttgcattgtccatggcaacctgcatttcagccattgctggtcctaccatttcagcctaacaagatctctaccatttgtcttggtcctcaccaagtcttaaatccttccatgcccatagataaatctggttatcttctttgctttagcaatgcagccactaaactcatttatcttcccaataacctccagcatgagatccaagtagtggttagcacaagatgtccaaaataaggtaggaaacttgtccattagcatcctacctactagggttgaaatggttgggcgggcttacatttttatacctaggtccaaataagtcgcacgattcaaatgctacgactagtcgtgactagtcgacaagtcgagcgactagcagagtaagtcgagtcgttctggtcgactatcacctctacaccgacttctcgactagtcattctcgactagtctctcgactttaaaaccttgttttgtatttattaagtttttgcattctctagggattacatcataaatgatgtcacaattgttcatataggcttaaatatgacttgcatttgttactcagttgaaacagacaatggtgtcattttgttttcctggccaaaatgtttgccactatggatggtactcctctgctccgaagtgtaatttttttagttttgtcttaagccaaacttcttgaccaagtttatagaaaagtgcatcaacatctacacatcacattaaacagtgtatttatttggtactatgatgttaatatatctttttttctgcaaactttgtcaaagttagggaagtttgacttataacaatgctaaaatggccgacatttttttggaatggaggaaatatttcttttgttttctcacatgagccaatacctttttttttatcgactgctaattacaaccttcctccccaatctgattatggtcctggtatatgtacaaactccctaatgatctaattctgagcattattaaataccacaattcggtatattttagtagttctactattcaatcctaatggcccaatctaataacttgatcctaacaactgttacagactcacattgaaggaaaagagtaacccagttttctctgaagccgagatgtaattagataaatcattactcccctgacacctggcatacaacaccacttgttttctaagacttgctgcaagataatgcaacattcaacctaagagactgacaaccatgtattagttacttcggaacagcaatagatcaagtcaataactacaaagtggctattacagagcagtattatatcttcaagtagaatttaaagagaatcccattgatctcaccagtgttatactgttactacataatcatctgcactagacctcgtatcctcagaacagtgccaacatctatttccagtgcattttttcccattcaaaatttttagtcggcccctacctgttgtttccttcgttttgatcttttcttaatattaggtcaaaacagcagaaactggatatatgtcccgcagattgatgaaaggcttggaagatctctcagttttctatgatcagacagttcgaaatgctagcggtggtatagttcaatttttgtatggagatgatggcatggatcctgcaaagatggaaggaaaagatggcatgcccttaaatttggatcaattgtttatgaaagtcatggttagtttaatgtacataatactttgttagatagccatgaaaatgtgctctgatcatttaacttctattataggccacatgtcctcaaaggggatcagatacattatctccagtgggcatcaaacagatgttagaggataagttcttgcagcatgacacctcatctgatggtggctgtagtgcagagttcaagaaaaacttaactgaattccttgataaacgtatagaattaatgaaatgcacaagaagggcactccatctacatgaggatcatgtagaaaagaaagattcttgcctagaagaatctattgctgctattatatctggtatatctgcaaaacaacttcaggtgcgtgtttataatcttttgtaaccctttctattatcaaag

SEQ ID NO: 687 - DNA, 93560 bp, Zea mays
  misc_feature (50846)..(50945): n is a, c, g, or t
  misc_feature (53665)..(53764): n is a, c, g, or t
  misc_feature (56922)..(57021): n is a, c, g, or t
  misc_feature (58039)..(58138): n is a, c, g, or t
  misc_feature (63336)..(63435): n is a, c, g, or t
  misc_feature (64554)..(64653): n is a, c, g, or t
  misc_feature (68909)..(69008): n is a, c, g, or t
  misc_feature (76238)..(76337): n is a, c, g, or t
  misc_feature (78358)..(78457): n is a, c, g, or t
  misc_feature (82085)..(82184): n is a, c, g, or t
  misc_feature (90952)..(91051): n is a, c, g, or t
caaagtgcacacgaaagattcgtgttggtctgtgaggacgatatatgatcctagagagctgccaggagtaagtaccgccggtctgggagtggacggggtgttacattctgctcctcttcctcctcgccgacgacaggttctctctgcagaggtctcgctcacagtggcgggaggccatccacgcatgtgagcaggccttggtgctcgacatcgtcatgctcctcttcctccttgtcggcgacacggttctcgccggagatatggcgctcacggtggcggggttggcgacgctcaggtccttgttgctcgtagaggagatggcacacaaatcaaccgttgtcaagataggaaggtagatgcgagccgcccaggcagtcaccgggcccggggcctgccagcgtatttttaaaattgggctaatgaacgccactgagcggcgaggagcccatgcagtcaccgctcaggtccttaatgggctaatgaatgaatgaaactttatctctttttgtgggctgcttcatcattacgactaatggacatgaacggcgaggagcccaggcagtcaccaggcccggggcctgccagcgtatttttaaaactggttaaaactggttgtttggttacttcccaagtttgtcatggtgatgtcttttaaacagagagtgagtatggtgatgtcttgaatggaatatatggaattatggatgctttgatatttgggtgtatccctgatattgtttcttccatataacctgtattatgttggctttatgtcctgttatcttatctatgaaggcatttattgttttcttcttcgagaacgtggtgtgcatgtgtttcattaagaggagatgaagggacctgaaaagaatacagcagattacaactaagatacagtacagtactacagtgtgtaaagtgtcccgacaagacaaaaaaagggtgggtgttggttagttgttacagggcataagttgacccaactaaaacaaacatcgaagaaatgaaaccgccaaattagagggcatctggtggtaccaaatttccattttagtgttgtgccctccccctcctaataggtttcatggagggatcttgtgatcctttaagtatttgaaatgctgtgtagtgtagcctgcaaacagcaaaacacactaggacactctacacggttgcattgttagggctagtttgggaaccccaagggaaattagttcattttcccttggaaaaataggaatcccttgggaaattggagttcccaaactagcccttagagtgagatttctcatttaaagactagttctatcatcattatggagtatccttttgtctttactttttcattagtactaattatatatggattaaaataactgtatttcagtgtaatattcagagctatgtctgtttacactaatattcttggtgtgttattccttctgtctggtttctacttctgtcggcatgaattatttttctatgggactcctgtgcaggatggagctacatcgtgaacctcctgaagctattctgaatgccataaaatttgatctcatgacgagtacggatatggtatgcctttaatttcacacaacttctacccccaactaaattgttgagcatcattacacttttatacttttctttctcttttttgtgaacagaagctttctacaacttgtactatatgcttctggtcatctatgcaaatgcttactttcttatcaagtcagcacatagagtaatttgattattctattcattacattgtattgtcagagataacttttatgcaactattaaccatttcaggaaaaattgagcagcatgagcataatcgaagtgagtgatgtcactagtccgaagctaggattaccaaatggttccctgcagtgtgagacttgtggatcacaacgtggacgcgactgtgatggtgagcactattaagcatgcttacctaaaaatataatattaagcatgcagcatctaagcatctgctttgagtgcatttttgtgcaaagagaatcaacttgtcaaaacttttagggcattttggtgtgactaaactggcggcaacagtacacaatccatacttcatcgatgacgttgttcactttctaaaccgaatatgtcctggctgtctcagcccaagggaaggcatagatacaaaggtttgtaccttcctgactgacctattttttatccccattaagcactacatgttttgtctctttgccaaagttctttgattgataccataatttagtcaatgaattgctttcagattatctggccattttgtcaggagctctctttgttcatctgatgaactaaagtaacgcttgagagtccttgactgctaaaacaaatttcagtattactacatgttattgtgctatacattgatgagtttgtttgctgcatgttaccttacctcatataatcctttacttatttatttcagtaggtattgatacacacgaaaacagtataatgctttttgaagaaaattgtgtatattagtttgattcttactagcttagtgagctattattctctttgttgtttcttatgttagtcatcttgtcctgaaattaaatataatattgtagtcgtggttgcatcaaagtttaattcacaagccatttatatagtttgtgagttgaactagttaatcatgcagtcgaattaactctaactgattttttttaaatagagcttaggcatggtaaatttacataattgcctagttcacttatggactaagtgatgttgttcaactgtttacaagtgattttaagtgttatatccaatttgtaacatatggaagcacatggctaacagtagcgtcctggctcagtttacttttgttttggtaggtaatggtgtgtttattcccacagtttgctcttcatgttttgcctattttttgtatgtggtatagtagggtactttttttccccttcattgtatatgtttagttttcctcttgtgtaaccctgcttctggtattccaagggttgctcctttagggaaagtagtgacaaactagtgtttatccatgatattatgcctactgcattttcttatcatggttttatcgattcctaaaactagtagaggtgctcttgttacgacactaatgtttacacatccataatgagtaaatgacccaatggtccactgttaagtaaaaaccacacctttctcttataaatcactctttgctttattgattgaagagattggagagagaaaaggttcaagcaacatgcaagtattgttcggtaagtgcatgtttagttctattggtgcatatttctcccaccttgtattaaattttaaatcttctgtattttttgctggacagaaggatggctctaaactttaccctagcatagtctttaagacactgtcaagtccaagagtattattattcaagagtaaacttcacagaaacgccagcgtgatggaaagaatttcgattgttgcagaagctgctgacagaatgcctaatagatcaaagggtaaaggttcgcttgaaggcctgcccctggatttttgggattttgtaccttctgagaataaacaagtccagtcaaatatgaccaagataatattgtcgccctaccaagtaatgttttttttcagctatccatctttggtagaggctgttccatgttggtttccagtatatagatatactaattcactgtttttaccctgagaaaaggctgtttttttctattattttcaattgggtcactgctactcttgctcgagtagtagtagtagcctagtgatttaaaatgtacacttttgtttctcaaaccatgagagctgcatgtcatttcattaatggtaaaacggtctgattacatgccaaatccatggtttggttaacactcgcccccttatacatatggaaacacaacctctgctgctcagttgccttgtaacaagattagctgcttatctctagccaaggtccacaggtgcccttgttgtctcacctcgtgaagcaatgcctccgccgatggtttgaggccgtgtaagatacatcggttcctatgcttccagagcatccaagtaaggagaatgaccaaagtgttgaaacccttcctcgccgccttaggcgttcgccggatgcccttcgccaccaatcctagaaggcatcgtcgccctatgacaatgcaagggcatgtaggctgactcgatgtagacctgtgtgccaaacctgacgtgagaacacacaagaggttaagatgtgaaaggaaaaggggacataaatggggacatgggattacccattccatttggagtatttttttattgaatattctttccaattattgaatattctttccaattacttacaacatatggaaaatataactgggattaccaaacaagggcaatctgctccttgtatcacatatatatcatgtttcaaacactaagaccattcttgtttcatttgccatatttgcaggtcttctacatgttgaagaaaagtgaccctgaacttatcaaacaatttgtttcaaggcgggagctattgtttctatcatgtttaccagtaactcctaattgccatcgtgttgtagaaattggatatgggcttccagatggacgcctaacatttgtaagtactatgttttttggtgattcttgttatccattcattgtttttccagccattcataattagtaaccttcttatcttttagttaaccctatggaatgctagccttatagagtaaatctttcaatttttttttggaaagtcatttaattaagcaaatccactatacctttggtgaagtttgtgacctgatttgccatctattaagtttgcttcactccatgccatttggattttatttttttccactccatgccattgacagattgcatggattcacaacgtttgaaattaggatttgaagtttcttttcactccattagtgaagaaatccggttaggattgtggccgaaggagctgtctggtgctctggtattggtatgcccctaatgccggggatctcttggggctagtccaagtctctccctggttatagttgccaatatactgtactgtcaatagtgttaaggcccattaggcctaggtctactgcctacatcaacatcaacataaccttttagtcccaagcaagttggggtaggctagagttaaaactcaacaagatgtcaccaaaaggggaaagagagagaaaggggggaagcttttgagagcactaaaaggaaaaagtcctaatcacgggcctaatcacggttcgggcacgtggatagcttctttccaagtacttttttttctcgaacgcgcaagagacatgcacatcttttcattaagaaggaagagaaaaggatccaaaatggatcagtacaagaagacccccattacggtggtcgaaaacaaagaaacaaaaatacatccataaataaaaggaaccagaaactactttgatctaaagacctgggattggggatgttaggagatctaagcttgtagcccctcctaacacccacagatccctctcctcctcggtcctcttgatggcttcattaaggcagagagaaagaccgtcaaaaacacaggcgtttcgatggttccacaatatccagaggccgagactgataactgataagcgagtttagtccttttctggcaattccatgcaactggtcactatatcttttccaccaaagcatggtactctcttcatagacataggagtgaaattctggaggttaacctttgtcagcagcttgaaccagtaatttcttgcaaacacagctcacgaggagatggtcaatggtttccatttcctggtcacaaagagggcactgatcagggtgatcaagccccctcctctgaagtctgtcagctgtccaacacctttgcagcgccacaagccataggaaaaatttgcatttggggggggggacatgagtgccaaaccctgtcacaatgctcaaaatatgttgacccaataaataaactctcgtaggctactttggcagagtatttgccgttatgagcaagcctaaaaatgtgtttgtcctctctatgcggatttatgtttactgtgagaatagcatcccaaagatcaagataatcagcaaggacctccacattgagagctccttggatgtcatttagccaacttctatttgctagagctgtatgaacagttctactattttgaattcgccttggcacaactagtagtaatctgggagcaatatccatcacatttcgtccatgaatccatctatcttcccaaaaaagtgtcgagtatccattgccaatttccgtgtgagtggcagcatgaaagaaggatttcacctttgaaggaaaatgcatagggagtcctgcccaaggtttatcaggttccactttagccagccacaaccatctcattctcaaagcccaaccaagttctttaaggctgaaatgcccaatcctcccaactcaactggcctgcacactctaccccaagccaccaggcagtgtccccctctgacttctttttttccacggcacaggaatcctttcctaattttatcaatatccttgaaaactcttggaggtaagtccaccgccattgcaaggtaaatgatcattactgtcataacatattgaacttgcacttttcttccagctctggtcatcaagtcagctttccacccagggagctggtcagcgatcttgtcgattatgtattgagtttgatttctggaaagcttgctcaaagacagaggcaggccaaggtatttacaggggaaagaagagatctcacaagggagacactcctatctaaacacaactctattgggatattccattccttcaagtcccttttgattgcctcctcccatgtcaagttttgtcgacctctacctctcttcacattattgtcccatcttatgatgcctctatgcaccggtgactctgggggtctccggtggacatgcccaaaccatctcaaccggtgttgaataagcttttcttcaattggcgctacttctagccgatcgcgtatgtcatcgtttctcactcggtccaatcttatgcgcccacatatccaacgcaacatacgcatctctgcgacacttagttgttggatatgtcgtctcttagtaggccaacactcagccccatataacatagcaggcctaatcgctgtcttgtagaacttgcctttcaacttctgtggcactctcttgtcgcataggactcccgatgcttgacgccatttcatccaccccgctttgattccatggctaacatcttcaatatcaccatctctctgtagcatcgatcccaaataacagaagatttctttctttggtactacatggcctcccaaacttacatctccatcctcactaattgtagtaccaaagtcacatctcatatactcggttttggtcctgctaattctaaatccttttgactctagggtctgacgccataactctagctttctatttactccttcccggctttcatctactagaactacatcgtcagcgaaaagaatacaccaagggatatctccttgtatatccctcgtgacctcatctatcactaaggcaaatagataagggctcaaagctgaaccttgatgtagtcctatgttaatcggaaaaacatctgtatcaccatcagttgttcggacactagtcacaaccttgtcatacatgtccttgatgagcgtaatatactttgttgttactttatgcttatccaatgcttaccacatgagattcctaggtattttatcataggccttttccaagtcgataaaaaccatttgcaagtccttctgttccttatatcgctctatgacccgccttattaagaaaattgcttccatggttgaccttctaggcatgaatccaaattggttaatggtgatatgcgtcatccctctcaggcgatgctcaataactctctcccatagcttcatagtgtggctcatgagcttaatccctcgatagttggtacaactttgaatatctcccttgttcttgaagaccggtactaatgtactcctccactcctcgggcatcctgtttgatcgaaaaaaatggttgaacaacttggttagccaaacgatagcaatatcccaaggcatttccacacctctattgggataccattcgggcccatcgccttgccccctttcatcctctttaaagcttctttcacatctgattcttgaatcctgtgtacaaagcatctatttagatcatcaaaggagtcatccaattggatgtccatggtctcattctcaccattgaaaagattgtcaaaatacctctgccacctctgtttgatgtcttgtcctttcaccaagagttgatccatctcatccttaatgcatttaacttggttgaggtccctcgttttcctttctcgaatcctagatatcttataaacatctttctcctcttcctttgtacttagtcttcggtaaagatcatcataggctcggccctttgcctcactcatagctcgctttgcagtcttctttgccaccttatacctctctataggtctactgcctatatatatatatatatatatatatatatatatatatatatatatatatatatatatatatatatatatatatatgttctatagtccatagggactggtcatctctggttaatcccaaggttagtaacatgaagttatttttggtacacctccgcgatatgattatcttcgagtgtttggatgtacgtgttatgtcttgttaccaccacgtgagaggactaaattgaatgctcaatctgttgagtgtgcttttcttagatacagtcctgaacacaagggctatcgttgttatgatccatctactcgcatagttgttaaagcggtaaggcgacaggccccccctttaaacttttaagcagtaaagcgtaaggcgaggtgacaccttaattgtttagataaatataaaaaattagaccaaatattatatatgtatcactaattcatacttaataacccatttcagtcttgtagaatagaaaaacagagtaaaagaaaaagaaaaagcccacaaattgagaactagagaaaaagaaaaagaaaaaggcccacaaacaacccaacaacacctaggttaaaccaactcctcctctctcttaggctctcagccgccgctgccctcctctcttcctctctggacgccttcctctttccctctccctagcgccgcgcgctgcgcctctcctaggctctcagtcaccgccgccctcctctcttcctcccccgttgctctcctatctccctcaccccgcacgccgcgtctctttcggcgacgcgaaggcgccaccgcgtgcgtcctgcgtgccgccgttgtgcctctcccgaccccctgcatgccgttgccgtgcctcgcattgcccgagagtaaggcgacaagacaccttatgggtcccaacccgccttagcgtttaagcaagcgatgctttagtgacgccttaataactgtgtctactcgtcgtattcgtatttctagagatgtgagttttaatgaaaattgccccttctttcacaaccagcccactcactcatattatcccacagagtccacctctttcatgtgacttccttccattcccgatttttcatctgaaccatcttctatatccacacctgatgtcctcattcccataacaccaccttctccttcattttactcttccaaacctcctgtcatccaaacctacatttgtcgttcacgctctattcccactgctagtcctgatactgatcctgttccagattcttgtactaataatactgagtctcaagatgtttttaattagggatatcaacttcatgatcgtggcaccgttgaacctctagatcgtatggttttccgcgagctggtgtggcaattgttgaaccatccacttatcaggaggcttttgggattcctgagtggcaacttgctatgatcgatgaattgtctgctcttgaacgcacttgtacttgggatatagttcctttaccttcgcatgttgttcccatcacatgtaaatgagtgttcaaagttaagacaaaatctgatggtttcgttgagagatataaagctcgtcttgtggctcgtggttttcaacagactcaaggacttgattatgatgagacctttgcacctgttgcacatatgactactattcgtaccttgattgcagttgtcgcctcgtattcttggactatctctcaaatggatgtcaaaattgcttttcttaattgtgatctgcatgaaaaagtctatatgcatcctcctcctggggctgatgctcccccaggacatgtttgtcgtcttcgtcgcgccttatatggtctgaaataagctcctcgtgcttggtttgagagatttatttctatcatcatggctgctagtttttcttctaatgatcatgattctgcattatttgtccatatctctccaaaaggtcgcactttacttctattatgtggatgatatgataatcacaggtgacgattcagagcatatttctcgcgttcatattctgagccaatttgtatccacacctaactcagttcattatggtcatttgcttcgtgtgctgagatatttacgtgggactgtgtgtgtagcggtggaagtggtgtggataattatccgatccgattcgaatcctaattatacgtatatggtggagttattatggataatcataatccgatctacgtgtggatgcggagtaggatatggtatcaccaagatccgacggatatggagtattcgatatttgaacatgaattatctgatgcttaaaattgaataatatccgattagcttgtcaagtacaagatagggagtcagtcaacaatgattgtttactgtccaaataaaactgaaatttctatacggtagaacatgaaatgaaacactatccacgacagaaatcaatcgccacccgcaacccaacaggcaacaagccaacaagaatcaatcactgatctgccgatcacaccgtatagtgtgtgacgtaatgatatttattatttacctacttagtcatttattatagctatattcaagttatgttttcaattattaaactttaatttatgaattattgatcgctataaaaaatagatgtatacatgtattatccgacctttgaaatccgcttctgccacgcttgcgatccgactctgcaccattttcgacatcctaatatatccatatcactatccgcaaccgcataatatccgctccgatctgaatccaacaataaaaataggattaggatatggaaaatgcgttatccgctccgatccgtttgcacccctatgtgtgtgtgtgtgggccggcacctttgttgggttgacgacccattagagttagggttctgagtctatatatgcaaccaccacctctatgcaatataatcaaagggtttcctacaagttatcaaattaggttttcacctctccctacccaacaaccgccggctctctcccaaaactagcagctgctgcttgctcctcctacctctagccgccagcaccctcctcgtgaggctcatccttctctcccgggggcggccaccatcccaaccgtcggtcacctcctccccggcgtgaccatccaccggggaccctgcggaggtggatctgcgcgcccctgccctcccccggctccggaggcacggccgcggtccccttccccggccacggtgcggtgccccctctccagctccttgtgtgagccccctggtgtcacgcgaccctccttgcgctccgtcgtggctctcttcacctctggcggcgcgcgtgcggccaacccctcttctcctttcctgagtgctgtcgtctccttcccatggccactgcagcttcctccctcttcccgtgtctactacagctgcccccgactcccttatcgctcacccctgtgccggtgtctccactcgtgcaaccccccgtcatcgcgccggctacttcctccctgcccgcgctgatgccatgcaacgctgtaacaccccgtcgactcttggaccggcggtacttactcctggtggctctaggaccatagactatccccacaaaccaacacgagtcttttgtgcgcactttgtcctcactcgtgcgcacctggggaaacttcctggttggtcacccatcgcaagatttctgtaggccaagcacgcttaacctggaggttcttttgaggtaggcttctgaaaaagaagatgcaccttgtggtatgaatactctattaattctattaagcgttgggctaggatatcaccatccacgagggctaggatatcacaattcacccccttagaagaccgacgtcctcgtcggtcaaccccaagccaggaacctcctctcttggccacatatgtctgccaagtgtcgtcatatgccatgccatgttgccactccgacccacatgcgccatgcgccatatgtccgaacccctagcctagacacactcgtgaaaccacgagggttggctctgataccatttgtaacaccccgtccacagccggaccaatggtacttactcctgtcagccctctaggaccatatgtcgtcctcacaggccaacacgagtcttttgtgctcactttgccctcactgatgcacacccgagaggacttcccggtcggtcacccaccccaagattgctctgggccaagcacgcttaaaccagaggttcttttgaggtaggcttatgaaaagaagatgcaacttgttggtatgaatactctattaattctattaaaccttgggctaggatatcaccatccactagggctaggatatcacaggcgccaacctttaggcctctccctcaagcttctcctgtcgttggcgtcaaactccttcctgccaggcccggtgcaggcccttgcttggctggacacgccccgtcacactcccccttcatcattgcctccgtcggatctatcgctgatgggccttctcggccggatccatgttgctgcgaccttcccggcttgatccgctgcccctttgtccggatcgtcgtcttcatggctggatccgtcgctgccgtggccttcccggctggatctgctgatactcctattctgccgcaggcgtgaccaccatgactggcgggtatcctcgacgtccagacgatcgaagaagcaagaaggtcggcctgctggtgcccttttgttgtgttgtcctgctgaccgttgaccctcgtcccgaagaacaggctactgttgcgtctcccgaccacgaccacctcgacttcggctaccttgacatccaagggctatcgtcttcttggagtccacaccggtctctactcgaaccacaacattcgcaccctcacgacgctgcgactgcggggggataccaacccgtcgcctcctaccttcggcttctactccagtctcatcgtgtgtggggcccccgttgcgactgcgttgggatgttagactgtgtgtgtatgtgtgtgtgacgacaccactattgggctgccggcccattagggttagcgttctgagtctatatatatataaccaccacctctatgcaatataatcaaatggtttcctacagggacaagatccagatgtttactctatgcttctgatagcccacttcagtttcatcctttgatgcaacttgggcaagtgacccgattgaacgttgctctattacaggttatcgattctccttgcatcctcccctattgccagtaaatccaagaagcaagcaacaatatcttgctctagtaccgaggcagaacttcgagctctttctactactgctgctgaaattatttggttgcgatggcttttggctgattttggtgtcacctctgttatgtgataacatgggtgctacacatatttcacatgatctagtgaagcatgaacttactaaacacattggtgttgatgcatcgttcacctggtctcattgtcatcagaagattattgatcttcaatatgtgcccttagaatctcaattcgcggatttattcacgaaagcacaaaccagcgcacaacatcaatttcacttgatcaaacttaatgcttaagatcctccacttccaccttgagttttggggggggggtgtgtgttaaggcccaggtctattgcctatatatatatattatgtagtccatagggactggtcatctctggttaatcccaaggttagtaacaaatagtaccactgttctaattttttagcatgtgtgggtgcatgatgtttgtgcattgtgtttggatgtttatctttgttacagagagaggtagacaagtgatggagcaatatagggagcgaaaggacctaaacatgaatttcatagacctggagaaatcttatgacaaaacactaaggtgtagtgctagttgatgaaagccgagctagagtaaattggaaattggagctgtggcgggaggccctagagtccaaaggtatgtgactttggcactactacatatgaggaaacatatgaggaaggagatgttagtttggaaattcaagtagtggccaagaaggataccttcagtatttaggaattaggatcaatactacatagggatggggatattgatgaagatgtgagccatatgatcaaagttgggtggatgaagttgtgtcaagcatccgacgttctgtgacaaatagagtatcatagaagctaaaaggcaagtttcataggatggcgattagacctgctatgttgtatgctgcagaatgttggcccacaaaatgacatatttagcaaacaggtgtcgaggaaatgcctatgttatgttggatttgcggccatacaagaagggatcatgtacataatgatgataatgatgatatacgtgataggctagaggtagcaccagttaaagaaaagcttgtctaacactgattgagatggttgtcaaatggacatttctgcccagctgtgaattcaataccttggctgtcattctgctgaatctcccaccagcattcttaagcccctcaggcatccgaagacaaggttcagctaggcgctaggcggaatctaggcggtgacccattgcctagcgcctagtcgggagtactcggtcttaggcgcttctaggcgcttttctaggcgttttggcaatatagccataaattatatatatatattatgtatataactatatatacgttaatacgtatataactactatatatgactatatgagtcacagtaagtataaaaagaaggccagtagacatatctgattcctagcttagcttactcttgcatgttcctagctcctgcaaggctgcaacacattttgacagctagtagttagtaaattagtcaatagacagctagctgttcataaaaaaaatagaaaacactaaattgtgacttatctggatgatttcagcagcctcccattcatgagcagttgagcacactgcacaccatatcagcagctggtaattacaacacaagtggataggacagtaatacaagtgcagaacacaatttataaataaaggacagcacaagcacatagttcttagttcaggtctcacacaaaagaagacacacagacacaaagtgacacaactgcagttcataagaccagggcatcacaaaaggcttcactactagatggagatggtccagatcatatttcatcttcactgtagcacaaatcttcatcttcatactcttcttcttcagactcaaactcttctccttcatagagctctctcactcttgcacttctacgaggctcaagctgttcttctgctcccactgcctctccaataacagaccaaggtatccctgtaccttccatctcatcttcctcctcatctctaaagacaacttgtgcacaatcatctccaccctcttggagaaaaccttgagcttcagttgtatcactagacaagagaacatcagtgattttctttgacttaatcttttctctgttattcatcagcctgttattgaactgaatatagaccaacttgttgaggcgggttgtagtcagcctatttctcttcttagtgtgtatctataaattagaaacaaaagcattttcagttctgaaatttaatcatagtactgctgaaatgattaatagataggtactaaccccttcaaacccactccaatttctttcacaaccagaagagcttgatgtcaaagataatatccttgtagccatcttctgtaaagctggtgtttcagttccatataaccgccaccatgatgctgaaataaattagaaacacctctattagtttaaaaaacagcaaacaaccatggtagaaaacagcaaacgaccatataataagtagttaagtacctctacctggattgtaatcatagttttgaaaagttcttgcaagcttcttgctaaatggtccttctctattctgaaattttttcaattcaaagttggcagcctgttcttgttggtcctcatcatgataataaaattgctcgacacaagatatgaaggcttcattcattttgggctcatcaaatattgatgggttagcatagctatagtgtggattcagcaaaaaagctgtcaaatgcaatggagaatcaagtcttccattcatcttcttctcaattacagccataacatctttgaatcgagactcaacattgccaaaggcctctttgatctctctttttgcctttagtagctctccataaaggaaacccatggatggcttcacatccccatcaaccaaacggaggactttgaccaatggctcaaaaacagccaacattagcttcacatccttccaaaaggctggactcaatatagtagctgtggcctcttttcctttctttgatttcacatcctttaatgagtcccacctgctatgaactaccatcttccttaactggtccttcttctcttgcatactgttcaaagtgagaaagtatgaagcaaacctagtcactcctggcctcactagctctttcccctctgtgaagtatctcaagcactccaatgttcttgtgtggccatacacaaatatggtaaatgactttgcttggtcaatcactttcctgaaccgaggcaatttgccaattccttggagcatcaagttgattgtgtgagctgcacaagaggtccaaaatatttgtggtctcttctcaagcaatagcttctttgctcccatgttgttagaggcattgtcagtgactacttgcaccacattttcttcaccaatgtcttcaattgctttgtccactaattcaaaaatgacttcgcttgtgtgtgacacatctgacatctcttttgagctgatgaaggaggttccatcagcacaattagtgcatatattcattatgcttctcctcttcctatctgaccaagcatcggtcataatagagcaaccatttttcatcttctcggcttcacgttcctgcagcaaacacttggttctttcatattcttcttccagcaaactacctcgaaaagcatcttgagttggaggtgtaagtcctggtccaaattgtccaattgcttcacacatttgcttgaactcatcattgtcacatgcattgaaaggtattcctgccaatgattaaaaaatgaagtctaattttaaaatgtgttcagttcatgaattttaaaatgtgaaaacagcatcgtatactagcaatttaccatgattataggcccatcttgcaataaacttgtgcacctcatgctctctttctttccatagttccttgttcagctgctgttgtttgaatgaatcagccttggtaggatcaatagcacgtgtccatttgtcaattggccctaatttgtgaggctgtgagcttccaacacaagtgacttcttctgactcctctccaaccctagatacattcacttcctctctaagttctagctcacgaacagtcttctcctccctcttcctttttgcagcctctattgctttcttgcacttctctttagcctctagagcctgcggtgttgcagacgtgcatttcttcacgttctttccaacatgggcaagatgctccttcaacctataaatccctcccctcatctccttgtcacagaacttacacttcaccttgtctttgttgttagcatcaacaagaacaccatattcccatccaacatcatctgaatttctttttaggagattcgctctagctgcttcagtttcagaaggtgcagctgcagtttctgatgacatccttaaaccttaatccttttatttctttcacttgtacactgcacaggggaggaaaacagtttcagcaggggaggaaagcaggggaggaaagcaggaaagcaggggaggaaagcaggggagggggatgagcagggaggggagcagccgacggggaggagaactcaccggcgggggagcagggagcaggcgggggagcagggagccggcgggggagcagtttctgtcaccgtctgggagggagacggctacacagcgggcgctaaaagcctaaaactaccgcgcgctaaacctaccgcgcgcgcgcgctaaaactaccgcgcgatgcgcgcgctaaaaataccgcccgccaacgcgcccgccaacgcgctaaaaatactgcccgcgcgcccgccaacgcgcccgcctaggcgcctgcgcgccgcccactcgccgcctaggcgcggctgcgcgccgcctagtcgccgcgaccgcctagaagccgcacagggccctaggctacgcggcaggctgtcgactagcgcctaggcgcgcctaatcgccgcctaggcggcgcctagccgaacactgtccgaagatagcaattggttccactgggggttatgaaactagtcttcggctcatcttccttcatccagatctgatgataccctgaattgcaatcgagtagactcatgagctccgaagttgcagctgcatccactagtgagtcaattcttggtaatgggaactcatccttcggacttgccttgttgagatctgtgaaatcaatacacatcctccacttgtcgttggatttcttgaccatgactgtatttgccaaccgttccggatatgcaacttctcttatgactccagcactgagtaatcttttaacttcggctttttcaccttcggccttatcttcggacatcttccagagtttttgcttgcgtggcctaacacttgagtccacattcaaggcatgctctattatacttctatccactccacatagatcatttgctgaccaagcaaagatatctttgctgtgaaataggaaccttcgaagattggactcttgctcttaagtttgctgtttgccgaagaatacctttgctctgcgacatcatcacagagaagtattggttttggctgatccgccgaagatgccttttctttcactggcttttcagaatctcggatttgcctttcggcttcatcgatgttgtaaacaattttcggctctggcagggtcccttctgcccttcttgctgtttcttggctaccatacactgatattaccccttgattgctgggtatcttcatgcagatgtaagctgaatgtaaaactgcttcgaagacattgagagttccccttccgatgacaatgttatatgggaattccatatcaacgacatcaaacattgtatcttctgttcttgtgtggttgacatagccgaaggtgacatgcatgattagctttcccaaagccattacttgctgtcctgcgaagccacaaagaggaaaagctgagtcttggagttcatcttcgagctcctgcatttgtctgaaagccttgacaaatctgatatctgcaacactacctgtgtcaaccaaaatattgtgtactacaaaacctttgattacacaagagataaccttggcatctctgtgtgggtaatctttgagacgaagatcatcttgagaaaaagtaacagggatatgggaccatttacgatccttggacacctaaatgcaacgcccttttttgggcttctttcttctgctttttattactgggttcgaagctcgagcgcccagtaatggggagagtaagcttctccatggaagttgacgaagcttgatggcttgccatgctcttcgtcgtgatgaagattgtagtggtcgtgagatctccggaggtgggtgccaatgttggtcacttgttttcaattgctgtatggaatcgaaaacaagacaacacaatgataaaaaagtagaaacctttgtccttatctatagtcaccagtgaggaagattgaagttgacataggaagagatagtaaaaggagatttggaaggatagaatatacctaaagatttagccttgaataaaaatgcattgaaaccaactatctatccacgtgcctgaacttggacttgtggcttctgttgggtttcaattctagcctatcccaacttgcttggaactaaatgctttgctgttcttgtaatgaaataacatgtagctttcctgcatgttcaaaaaaaagaagaaatctgaaacctgaatggcttggataatggaaaatcattactagaagttctctgatgtcaaataattaattacctctttaattgatgggagaacttacatgatcatcttggattcttgagtgcttggactacctgaaagcataatgatccgtttatctttgagtgttttggaggtcgagacagtcttataggcattcttttttttgtagaagttgatctgtggaatgtgtgcttgagccaggggtttagcacaacatttgtcccaacctagcctgcagtatgatctatgtggcatggcatgtttgcttttctctctctcctcatctcttttgttgtttgttttcaaggaggatgatccacccttctaacttagggtgtactcatgcgacatggtgtgaaacgatttcttcattgcactgccagatgcacaatcgtttttgcactcatcaaaactaaacgttgtggtggtctaatccactcatgtgcatgctacagtacatatttgaaccatgttggcatctcaattgtaaacacaatttttgttctttgcatatttgaagtaggatgacagaacaaaggcttacaagaggatggttgatgtcagtaggagaattgatgactaccgccagcatccacatttcagtgttcttgcaagttcacttgtctcaagccgggtttcagaatgcctaaagtcatccaaggttagaattatcttctttctattttgaagtatgcatacatcacgataaatgccatcctgatatgctgggtctgtgttcttagttaaaatcaagtgtttgaatgcaaacggtccaacctaaagtttttattttgtccatacccaattatatcactctaacctagaagttgttgatgaaccattatgtttatttaacacttctaattggttggttgggttatcactcatcaggctaaactatggtgctcttatttgagaatatctggtttattgtgttctacacactgtcacactcataagacctattcagctaagcctttccttggaacttaacctgaccgcagaagggaatgacagccttcttgaaaatgatcaaatgcatggttcggaactgttaccatgaagtcatgaaaactttcgatacttgttcatgagtaatgagttttcgaggagtatttgtcaaatattgaaagaatatctgcatctgatattctgatacatgagcgttcataagttttcactcaaatccatttcagttgcactggagtaacttaaaccttcaatttgctgaagttcttaattatcttcatagctttagctagctcctttcgtttcacagaacttattaagttattattttagcctgggcacaagaatgaggtagacaaaatgactatcctaccttggttaatcccaaccatgcatttgtgatgtcaaaagcacacactaactctcccatactagttaatgaaggaattgagggatatgattggaaaaggtaggtcaagttacctcaacattgtagaacaagtattctgactgtaatagaagagggcaagagggtaaaacaatgagcattgttaaatggatggagtaattatcttaggaagttactttggaataacggaaaaaggaaaaaaaactttgttaagcgctagtaacaataagttaattctgatattacaactgtggtgctagtaattgtttaacattattcattgacatctgtatctctttcagttgtactctaaaaaggcagatggagagacatccacagatacatatggaatgaaatggctaaaggatgttgttctcagcaaaagatcagataatgtttttaggagtattatggttggagacccaaaaattaagttatgggaaattggcattcctgaagatttatcctcaagcctggttgtttctgagcacgtcagttcttataattttcaaagtacaaatctgaagtgcaacctgcaccttctagccaagcaagaactatttattcggcgaaatggaaagctaatgtttcttcggaaggcagaccagctagaaataggtgacattgcctatagaccattgcaggatggtgatattattctcatcaacaggcctccttcagttcatcaacattcattgattgcattatctgcaaaaattctaccaattcactctgtcgtatcaatcaatccactatgctgtacaccttttgcaggagattttgatggtgattgtttgcatggatatatcccacaatctatacgctcaagggttgaacttgaagagctggtaagcttacacaaccagctgttgaatatgcaagacggtcgaaatttggtgtcactaacacatgactctctagctgctgcacatttgttaacaagtacagatgtttttctgaagaaatctgaattacagcagcttcaaatgctatgcctttcagtatcaacaccagcacccgcagttattaaatctatgaattttcaaggttctctgtggactggtaaacaacttttcagcatgcttcttccttcaggcatgaatttcagttgcgatacggagttacatatcatggacagtgaggtgcttacctgctcactgggttcttcttggctacaaaataacacatctggtcttttctctgtcatgttcaaacagtatggttgcaaggcacttgacttcctttcttcagcacaagaagtactatgtgagttcttaaccatgaggggtttaagtgtctctctttcagatctctacatgttctcagaccattactcaaggagaaaactagctgagggagttaagttggcactgtatgaagctgaagaagcttttcgagtcaagaaaatattgttagatccaattaacataccagttctgaagtgtcacgatgaaactgaagatgtaacttacagacaatctgattgtatccagagcaatccatcagttatcagatcttcaatcatggcatttaaagacgtcttccgtgatctcttaaaaatggtgcaacaacatgttagtaatgataactcaatgatggtgatgataaatgcaggaagcaagggtagcatgttgaaatatgctcaacaaactgcatgtattggtcttcaacttccagctagcaaatttcccttcagaattccttcccaactctcatgtattagctggaatggacagaaatcgttgaactatgaagctgagagtactagtgaacgtgtgggaggtcaaaacctttatgctgtgataaagaattccttcattgagggtttgaatccattggaatgtcttctgcacgctatatctggcagggcaaacttctttagtgaaaatgctgatgtaccagggacattgacaagaaaattaatgtatcacttgagagatatacatgttgcctatgatggaactgttagaagttcttatgggcagcaaatagtgcaattctcttatgatagtgttgatgacctagtagataaactcggcgccccggttggatgtcgggctgcttgttccatttcagaagctgcatatggagctttggaacacccggtcaatggtttagaggactcccctctcatgaatctacaagtaatattctatttctgttcctgttaatgcctatactctatactttattattatgtgtacacggcctctattttcccaatgtcatgatatgtgtgaattttctgtgcaggaagtatttaagtgtcacaaggctacaaattcaggggatcatattggtttgcttttcctgtcaaggcatttgaagaagtacagatacggtctggaatatgcatccctagaagttaaaaaccatcttgagcgagtgaacttctctgatttggttgaaaccatcatgattatgttagttcacttaaatactgtgttcctgtcatttgatcttttaattatgttattcatgtaaatattgttttcctgtcatctggtcttttgatactgtgcttttgtttaatcaatgtttcattttgtattagatacgatggacatgacaaaataagaaacgaaggaatgtggaccacccattttcatataaacaaggtcttattttttcacaatgattttcttttatttgcttttcaaatcggtgatgtaattatctgttttattatgtatatatttgcaggcaatgatgaagaaaaaaagattaggattgagatttgttgtagatgaacttgcaaaagagtatgacaccaccagagatcagctaaacaacgcaatcccatcaattcgtatctcaaggaggtaagcaccaaacctatttgtgtttcaatgagtgtctatatctatttattggcttcatcttttttctcgaacgcgcaggatatttgcctgtcatttcattaagaagaaataaagttacaagcaaaggaggggaaaccccctcccttaccaaacagattacagaatcaccagttcaccactaacttctaacaatacccatgaccagggatcgacacataattaaccaatgaaatgtgaccttaaggactcaactaagagttcccgcagggcctggccaccaaccatacaccagagggaacactcactagctacatttaggagcatatcagggatgctgcatattagagtgttttccttgttgggcttaggccctgtatacaacctattaggggtgctcctatatgtatccacttgtgctggttgatggactgttttgtttttctcctccaacatggcgtcaacaaccttctaaccttagccgtcggcccaccgcccgccatggatggtcgcctccccctggcttggccttccccctccctggcactgccttccactctttcctcttctcggacctccacctcctggccggccatcgcagggccatgggcgcctgcctcggatcccgttccactatcgttggcctggttggctctatcgaggctccgcccgtcgttagtgcttctccagccgctcccgccaagtcttgcgacgccagcctgtacgttgccctggccctgtcctcgtcggcctgcttgctcctagcgtcgttcctcccatgtcatgcgcgggccgtgactgttgctttcccttcttctggtgtcgtggctacgggcccgtatgccttggtgtcacacccggttttggaaggcaaaacgaatgcgaaccatgtacgtgtcaagatcagaattcacgtacacaacgattacataaatgacttatcatagcacaatgcttcgaataataataaagagtaagtaataatattacagacatgagtcataaacataatatatatcaaagtgcacataatagaaacatagccaacgtaaataaacccaccatagtcagctgactaggggaggtcgctagcctaatcctcgaactcgttgaagtcatgaaactcatggagatccgccttaacgccttcttcttctttacctgagcatatgctgtaccaaaggcaacctggtgtttgtgaaagcaagggtgagtacgcatcaacgtactcatcaaatgtcccgtttggctgaggtggactagctttatttggagttaggttcaaagagggttgcttttactttgtcaagttttattcattaatataaggcaagctttatcatcaatcccaagttgttatcccaaagagtacctcctcataggggaaataccaaaatccatagttagaaacatcattgatagaaccatcatcatcatctgtaaccaaatccataaatggaaccatagtatctcgaaccatctgtatctctaatcaaagaggatcccaatgccgctcttaaccgtgagcacgactgatatattagtttcattcctctacagaggtcgcacactttacccatgagacgtgattctctttttgcccgaggagcgctactcccactgatcacttcctaggtggtctggcagggtatcactacatagcttttacaaagattcccctggtgtatagccacccgttaggttgcgcctatcgtacagacatagtacacctccctaagggggtgactaacaaaacaaatcgaatgaacctcggcaccccacccttagcagagcaaacactatgccctagcccccattgacgccacaacaacgaagcaaactacacccccagattgcaccaattaatcagctaagggcgtcccataccacccacatggttgcactgttttcctgggtggtctctcaacgaacaggtccttacggagaggtactcgggtaatagcccgagcccccttttgcgccacaagttcatcatcacatccagaataaaatcatcgtatcataaatgtatctcattatgttcattgattaaagtagagcgctagcataaatgtatctccgtggccgcccttacgggggcgatgagcttcgtcagcgttggaagccggacgaggagccgtagggaccgcgggaggagggcgggcaggggccctggtcgacggaggacaaggggcctgcccccaggagggtgcctgaccgttgggaggagcgctgtaaagggccggagcgggttcctcggtcaccatggtgagctcctcgaggagaagctcgttccgcatgacatggaaggtgggaaagggtacgatcctcttgatgagagccttcaggtggccgtagcgggggctgaggctacacagaaggttcaacaccaaggtacggtcgcggagggagtccgccatgcccttcatctggtggtagtactccctcacgaagagatccacctaagagaactggtggaactaggcgtcgaggtggagggcccgagcatcccggttcctgaggaactattcctcgaggcgagccacgcctgtcggcccatgtccgcatagtcgcggatgatgtcctgtagcttgacagtgatggtgccgtggagccacgagagcaccacactgttcattagggaccaggatggagacgaaagacgacgaggtcgtggaggacgtggtcgacaagagcataccaccaaagcgtgaggaggacctgcccccgccaacgagggtagtgggaggacgccgggtccaacacggtggacacgagggaccggatgttgggcagcccagcgttctgagcgttgagagcggcgatgtggtcatcgtcgagtccagagagcctcatgagtgaccggaggagctgcctgggcggccgaggggtggtcgaggatgagacgttgcgcggtggccatctgcacggttagggcggcgcccatgacacgctcttgctcgagggcaagggacgcgtcgcgctcgcgcgcctgcgaggcagccacgacatcctggatcgtagcgatggcatcgaccaacgcggagtcggtggcagaagccgtcggcgcaggagtagcgagggtgaaacccgacgggggtcgacggggctgttgcgcgggtgagaggtcgtcggggagaggtgcgagatcgttgatgtaggggaccctgtccacgacgaggttgctgctgtgggtagaggggaagaggccatggccggcggagagaccctcggcggcgagctgctaggtggccgcggccagggctgcggtgtcggcggcggacgctgcgcccagacctgcggtgtttgtggtggtcgccgttggggatgtgccagtggggaagtcgaccatggcggaggcggggttgggggcgccacggacaatagcgggcggcgactgggggtgccgctggaggaggaagaccggctgcgggcggtgggggcagagcggcagccgggagcaccgcagcaggaggaggaacgggtcggtggcggcagcgcgccggcggctggggagccgacggcgggagggagaggatccgacgactgggggccgcggctaggagggaggtgaaaaaaatgaacctagctctttaccatgtggaaaaccctaaccctgacttagggatgggtgttgtattaatagacttgagttaactgctcctggcccattacacaggggtgagagtaattacatggggagaaccctaaacgggattctaacaacggcgatccacttgattgaggctctgggcatttcaaatgagaattgataacagattcatcttggcaagcttcttcgagcgatctaatttgcttcatctttaacattgtctgttgcttttcactacatgttgatacacatttaactaatttcacatccactttcctttttggaggaaacaggaggtgcttgcccctactggaaatatattaaacaagtacaaaaacaatctgtcccaaaaagagaaaaaagggagaaaaaaccctgaaattcaaaagaagctgtttagctagacactgatgctaggaaagtaacttctgagcactatgcagaagcattgtgaattcatgttcaaattcagttttacaagctcgtgcacagggacttgcttgaacatccagtcatttctcacaatccagatgcttcatgctaggatgatacttatttccatagagtgtgggactgcaaggccatctttgaaagccagaagaataaggtgtggattgtctagttggggaactttcaagttgcaagttgagtcattctagcagtcagtggcaaaaggacagtgcaagaaaaaaatgttccgctgttttgtgttctgtccagtacacaatgagcaattatgttttttttatcgaacacgcaggagaactgcgcatcattatattgaaagagagaaaggtccgaaatggaccaaagtacaatgccataacaggcaaatataaaaagaaaaaacagtgcagcctcatgcactaggaaaagccctagccctagcaaatgcacctagaagcccaagactctcgagctgcttcgcaccagccatacaccagcactccacctcatccaagaaaagcctctgaatggtgctcaatgaaggattgacaccatcaaataccgccttattgcgatgcagccataaacaccaggcccccaggataatgagactatgaaaagcctctgaatgagcaattatgtgggtctagccattttgtatgggcatatatgttatgtgtgatggaaaatgtttggcatttgctgtttgcatactgtgcattacaaaatgattatatttaaacaacattatttataatattaaattattagcttatttcttcattgtacatggctcagaagattgaaaaaaatcggttggtgtagccgtgtaggttcagtttcctgtataagataatcagatctcacattttacattttagacaatactgaactaagaattcaatatggttctcgttaaatataaaaactttagttctttttgagaatttgttctggaaaatgtcttgtattaaaatagttaaacttacagaattattgcagcaaaaactagttacatgcttaaattttgatttggcagtagatgtgaaatgaggccacacgccacatctctgctcattataaacttataatcatacagtcattgctatttgcattccacttctttctttgcatctcctacactatcttttcacatgtaaaacttctactgtgcagaaaatgtttagtaggtgacgagggtgttaaaagttcatcatgctgtatcgctgtcgtagcacatgctgaacgcaactccatctctcagttggacactatcaagacaagggtgattccaagcatactggatacactgctgaaaggttgttacgttttgatacatttacaaaatatatcccatatatttactgtgactttcctgtagaagtaagaaatcatggtctgagctatataggattcctttctaaactgcagtgcggaggggcaaaatctttccaggtgtagcttgtatggctgtttcttctgaaattttgtgaaaccatagctcacttcatttggctttttattattctagcatcacatgattttgtagcaaaaaagtttgaaccacttcatcctaaaaagaatgtcatcctaggtttggctgaagtcaaacttgaacgttcgactaggtttataaaaaagtattattaacatctgtaattccatctgtaacccagttcttctttagacctttcttttcttcttaaatatatttaaggcgcagttcccctgcgcttccgagaaagaaaaaactccaaataggttgatatgaaagtatattccattattcatctaatgacactatttacgtatcataaatattagtgtatacatcgactcctcgaaaagcgagaataacattctttttgggacgaagggagtgattctaaatagacattaactataaaatttagttgtcacagaatataaaaagggcagcccggtacatgtgctccagcttgcggggtcctgggaaaggtcggacctatttgggtctatagcacgcagccttttcctgcatttgcaagaggctgtttccacaactcgaacctagaggtcacaaggcagcagctttacccggcaccaaggttccccttcagctgtcacacaatatatctatgttttttccttgaaacacagaagagctgtgtgtcattgcactgattccagatctgttgatgtatagagatcttaggaatgtatcaagtgcaaaccagctgttcgccactacaatgctaagtcactagattcgggaatgaaagtaacttagggtgtgattggttggctacattagactgtatccaggcttgcacagtgagaccaatgcttcattagctagtgtgtcagatttttccgtattagataatacatgtttatataagccggtggacaacaacaacaacaaagtcttttagtcccaagcaagttagtataggtttttttctctcgaaagcgtaggagaactgcgcatcaatatattaagaagaaaataaaggtaccgatggacccaaagcctccacaaccaaactcatcgaggccaatatcactgatacaaataaaggtccatagagctaaaaattaacgcgacatgaacgcacacgctgcctaaggccaaagcgcacgaaggcctgaggctccagctaggcaccataattgagcctcaactgtgaatctgtgatatccgataggagcaagatgagatggcccccgctctgccctctcccgctctgccctaaaccctaaaccctctccccttcaacccacccctttcccttccgacgcccacccctctaacagcccctcgtcggtctccaccctagatccggtgaccaaccctctgtccttcaacctcccggcgcggtctcccaggtaggccgttcgaaatcctagaggtggagtcattccaactccgtctcctcgtccggcgggtctggttttgctccaggctcctataaagatgatgttctctccagttccaagcgtgataccggctccctctccacttccaaatggggtgcctgctcccctccaactgctctgactccactagctcatgtgtcgaaaaccagtgtgctctctaggtcgctgatacgacctgttcggcgacaaggacaggaagaggaaggctggcagttggttgagagcaggagaagacatcgttttgctgtgccacttcctcgtcgagggtcccaggtggatcttcgaggcaagtgctacaactgtctttctgccccccatcttgtcgtagcctttcgtagcccaacgcagtgtttccggtgcttcaagcctggccaccaggcgacatggtgcaccacccttcctgagtggaagtcagtgtgatagcggctgagtcatcaagggtcgtgccctccgttgtggcaacggttgtcggtgcagaggggacccgggcttcaggaggaaggtaccccatggctcagcacaaggaatcggtatgggtaagaatcactctgccattagaagctctgatgaaggattctaatgaggcattcgactctcagcgctacctccgcaacaagaggaaaaggagaagatcgaagaaaggaaaggaacgctctgtcgtcggcaccagtgcgagacatgagtctcccatcccacctgatgatgctgatgccaaccgctctccgaaggtgcaatgctggccgtgggacttccagccgttgccagatgcttcaattgatgcttcatgtgttatggttttttctgatgagatggttcgtgaggaagttcgcttcgccgggccttgtttgtcacaatcgctggaaccagacctgaggtgctaggtctggaaagtctagaagaagtggctcgtagtttcgacgtcgacattaattcaatgacaatccatcattccttacctgaggacttcctgttgttcctccctgactaagaaacgacaaccatagtgctcaacgttggcaaggtatttaggggtcctcgtttcagtttactgttcaaaagatggtcaagattttcacatgtttcctcttcaaccttgcctcacttggtggatgtggagatccgaggaataccacaacatgtttggtttcgttcaactgcggaaatcatcctaaagattcttgtttcattgaagaaatccatccggacaccttgatgaagagggattttccatcctttgtcgtgagagcacggtgtttcgatccagaaaagttgcagcgagagatggacctccatattgctgagctaggattgcaagtcaacgaaaaaagatgcttatcctataaaattagagtgagggttcttcagggagaccgacaaaccaggatcatggttcctccgcatcccatcggatgacgacaatccaccgggcggatcaaacggcaacgacgatcaagggcaccaggactctcagcctcggcattcgggcggctcacaggatcggcagcgagtagctcttcttcgcctgggaccgcagccgctggttggacgacagagtcatgaatgcacctggagaagctgatgtcaccacgcctgtagcctagcggggatgaggctgcacctttggtgcaagattttcggttactgtctctggatactactgagccagcaaccgaggagtcgctggagaattatctgggggcttcgcagtttcccaatgacgttgtcgtgccccccgtggagaaggtgaatagtccccgatacactgtttatgattgatgccggacaagccccggtgggccgcagacctcagccacgtcattttcgcctcaacccatggtggttgggtcgctggaaatgactgggccaagatcgctgcaccctgcggactgtccccctcctatgcctctactcatgctgcaagaaaatggaccacagtacaatgcccaaactaggcaaacaacacaagaaacaaaaaatagaccaaaacagcaaaaaatagaatagccctattctcaactcatgctgcaagaaaacgaccccagctgccacaacgtaagtacttgaattagccctgaccatattgaaggcagcaggaaaaccaaggctctcaagatgctttacaccagccctactccaacactccacttcgtccataaacaaacattgaattgtgctcaatgaaggtcttgttccatcaaaaacagccctgttgcgatggcgccataagtacctggcctccagaatgatgatgctgcctataaataccctttcttactcgtttgtgcatttttctatgcaccttgccccaccacacatcaaaggatatctcatctatatcaggagtgagatgagccattctttttttgaacaaacgcaggagagttgcacatcattatattaagaagaaaaacataggagagacaagacttgtcaacccctaaaataaaggcccataggccaagacccccttcactctaacacaacgtgccatgcacacagagcgacaccacaaccaaagcgacaaccaacaaccaaactgctagggtcccctagggagctggcgcaggaggaggtcttgcagagctgatgcgccagtcaagcactgccctcctcaatcacatcacacctaacttgctgggcgcaaggtacaacgccctcaaagacacaagcattacagtgcttccaaatctcccaaacaaccaaaatgatcagggagttaagaccttttcttagactcacttttgatactttggcgccaccagtttgaaaaccgtgtgcatccaggctgagggacaatggctaggaggcccaaattgtggaggattaacgtccatatttgccgagcaaacacgcatgagacaagaatatgttggatggactcctcggcctgagcacacaaagggcaagcaactggatggcgcgggcctctttttaccagtctatcagctgtccaaaccttgtttttgattgccaaccatacaaagaatttgcatcttaagagggcccaggtcttacagacacgtcgccaaggggcaaaaaagatagagccaataaaaatgcatcatatgccgatttgctacaataagtaccatgaccagagaggcgccaaatatgctggtctgcgatgtcaggttgaaaatctaccccatcagctaagttccagagctgcagatactccactaaaactggtacagacaagcctcccttatatctgacacccatttacgatctgtgagccccttcgctactattctccgctttaaagcccttttaaaatcatttggatcagggttggacagtgttcagccatagttttaccaagaagccaacgatcagtccaaaacttcacagattcaccactgcctaccacggagacaacaaccagatcaaagagtgcctttgcattacagtgcactcggacagggagtccagcccatggtcttgatgcatttgtcttctgtagccaaagccacctggcacgtaaggcccatcctagcatctccaggttgagaatacccagaccaccatactgtaaaggccgctggacagtttcccaagacacaaggcgggttacctccatttgcatcaccttgccccttccaaagaaagcctcttcttctcttatcgattgccttaaaaacccatttagggagttccagcgcaagcataagatagatcgggacagaagacaacactgccttaaccaggacaagacgaccagcctggctcagaagtttggctttccatcctgaaagtttatcaacaactttataaactagtggcaagagatcggagttagagagcttacggatcgacagaggaatccccaaataggtgcaaggaaaaaatttatatcacatggcaataaggcagaaatggtggctagctcattctctccacattgaatgggtgtaactgaactctcggaaatattcgtttttagccctgtagcatgaccaaagatgtctaaaatgctgataattgctgagatatcctggtgggaaggtcgcaggaacagaacaacatcatcagcatagaaaaagatacagtgtttggcttattgagaggcggctgcaggatatgcaagaagagcacctatcgtatcttccttgatgatatcccaacaaactttataaaaacgacctgtgaacccatctggcccgggagccttgtccaaaggtagatcttttacaaccgaccagacttaccataccagaactgtctagcaaaactgcaagcgcataagaggtgcaagatagtttcctgttcctggtcacataaaggacataccaccgggtgcggtaatcctcttctttgaagcctatcagcggtccaacatttattccttattaccaaccagagaaaaagtttgcatttagggggcgaccatgacttccacaaccttttccatggctcaaaggaaatagctctcataaagaacgccttataacatgacttggaggagaaatgccccgagactgaatgcgcccacacatgtttatcatcctcttgggtaagcactacccctcttaaagcatcccataactgcaagtatttgctgtagccccaacaaagacaatggattcacaatatcactaacccactgccagctatccatcgcctgagcaacagttcttgaagaagcagttctgctgcccaccatacagacaacatcagggctaaatcttgtaccgacttcccatttaaccaattatccgaccagaaaagagtattggcaccatttcctatcacagataccacaaaagacttcaagaattttctaacttgctgctgcacatgaacagtcaacccaatccaaggtctagatggatcagttttttctaaccaaagccatttagcctgcaatgcccaactcttaagctgtaaattaggaactacaagaccccctaatcttagggtgtgtttggtttgacttttggctttggcttttgccccctaaaagccaaaagccaaaccaaatggctggatccagaaagcagttttttctaaaagctgactttttcgcagtgcaaaactgaaagcacctctggacctgctttttgtggctttcagatgaaactgtgaaaacatatatcgaagaacttttaacggattttagtggtttccaccaaatggtttttagctttttaacaactcacagtccacaacagctttttccacagctcacagtccacagcagcttttttcacagtcacagctcaaccaaacagacccttagtggccttgttactatttcccaagggacaagacaacttccaccattcacctcctttcttcctttccgtagaaaccctcttcgcctcagtcttgcactgggattagagatgtcaatggggacccgatacccgataacccgtggggaattcccctattaggtacgggtatgggacaaaaattgtccccatgggtatggatatgggacaaaatctccaccccattgggtaaacgggtatgggtttgggaagcaataatccgaacccgattacccatgggtatttcatacgcgtacacctgtcctgtttgtatgaatgagttgaggccgagtcggccatcaaacccggcagactccatttcttatattggtcccaagtactgatttcttttctgatggatggatgaatggataatggttcatggatgagtgcttgccgatgtggtgatgtatgaaatctagatagtttgtgctagatgttagtacctagttattccttaatttgggatggggacccattggggacccgaaacccgaatggggatgggtatgagatgagttttgtacccatgatgggtatgggtatgggtatggggatgtgtcaaacatgatggggatgggtctgggatgctataacccgatagggaattacccattgacatctctaactgggatgctagagacggtgatctctgactttattggatccatatcaatacccaagcagaagttccccgaagccgcacagctcaaagtttactagcgaagaagaagaaatgaggaggatcaggggcaggacagggcacatgacctgtcaggattggacttgggcgtcgtaccagccacggctgttccacctgagtcttacactgccaaccatatcctgaagaattcaatcaggaaggatcaaactgttgtttcggctgtttctagtgcaatggatttcattggcaaaataagtatgaaacctgcagccttctaccaaagccaaagctcactcagaagaccttcattcccccctcttctgctactgctctgcgacgcagcaggcacgttgctgggataggagtggagtttaacatgcgagattggagctgcagagcatccaaaaaagccttgaaagccctgcacatcatcaacgaaaatgaagaagtcaataaagaagccctggatgactacgctctgcttttcaagaaccctctatcacaagctcaggtggaggccgccttatctgcactctttggctggtccacacctgcagatttgcagttccagtaacccccctggtggtagtcttgtggtttagttttctttatggatccttctaaaatattggtttggacacaagtcggccgacttgccagaccaagtcgacgactagtcgactgagaatttccagtcatctccaagtcgcccgacttgccagaaaagtcgagccgacctcaccagtcgagatcctagggccgacccaacgactagtcgccgacttgaaaactgggctggtggctaacttgtgtgtatgggcctcagggggataatgataaaattttgttcctccaggaacttagggaggtcagggctgcttgtctaggtccatggatgttggcaggcgacattaatatgatttacaagagctcagataaaaataactccaacttaaacagggccatgatgggttatttctggaaagtgattaatgatcttgccctcaaagagattcaattgcatggtcgcaagtatacctggtcaaatcaacaagacaatccagttttggttaaacttgacagggtcttttgctcagtggattgggactcctatttcccaggtgtgctccttcatagtgcagcttcccaagagtcagaccattgtccctgggccttaggaacaatatgtttggaaaaaagatattccactttgtatccttttggaccaaattggaaggctttcatgacattgtccaggctgcatgggattcagttcaaccttccagacgcccttttctgactctagaggcaaagctgaaagaggcaacaagaaaattgcagagttggagtgacaggcaggtgggacatgcttcgcaattagctttggcaagggacttactgcataagctagaaattgctcaagatgacagggctcttactccggctgaaacctggcttaaaaacaggctcaagaaacattccttgatgacggcgtcctttaaaagaacaatggcaaggttgagatctaggatttcacagctgaaggagggatatgccaataccaaatactttcaaatgcatgccagacaccgaaagaaaaagaatctgctgacaaagctgatggatggagatcgtatttttacaaattaccttgagaaggcagccctggtgaatcagttctacactaagctcattggtcagtctagggacagagagaacaattgatctggaggcccttggtctagtaaggcacaatctttctgaccttaactctcctatatctgagcaggagatgtgggaaaccatcagtcgtctacgttctgataaggccccaggaccggatggcttcacatggaggttctataaggtttgctagaatattatcaaggatgatgtgttggctgcagtatcagcagtatggagtaggaattttgtaaaccttaatagacttagcacagcctatatcacgatgattccaaaggagggagctgatcaggttaaagatttcagaccaatcagcttagtgcacagtttcgcaaaattgatcacaaaggtccttgctaataggttggaaaaaagattgaatgacatggtctcccaaaccaaagtgcatttttttaaaaggaaggttcattcaggacaattttatgctagtgcaacagacatcaaggttgcttcaccagcaaaaggtggctcggttccttctcaaactagatataactaaggcttttgattgtgtcatggcctttcttgcttgaaataaaacgacatttgggctttggaccagactggagagacatcatctgtgggttattggcttctactacaaaggtgcttctaaatgggtgtctcattctctactgttgttagaataataatacctctaatcgaacatataaggtgaccatatgtaataaaatgtaaccaaaaacacaattttattggacacgacttgtctatgaggacaagaaaacacgaaggcactgcatatgtttacgctggcttagcacttactgcgtaagttctaatgcaggctaagtctgctttacaggtccagactctagaattactttcttcttgggaaaataaggtaggattttgtttcagtaggagtagatggcatatagaaatgttactatgagctggtgacttctatttttgatccagttgagtccatgattgaaatatctgttggtggttgatgacattcagatatttacaaatctttttggaatttcttatgttggttgatgtccagataaacatttcaggtctatatacaaatcttttaggaacttctcatgttgattgatgtccaaatgaacaaaactagtaggttatagaacctaatatgttttttgcactaggtagtactacctccgttctcaaatatttgtcgcccgctagttcatttttgaactaaaacacaacaattaaaaaagaacagagggattatatatgttatgaagttttttatgagtgttatatatgaagtcacaaatgatgcccatgtcaaaggttcaaaggtggttctgatatcaccaatgacagacttaattaagtcagtctccaattaaccaactgatttggcaaggaatcagttaagcacctagcatacaacaagctatactgatagttctgagaattcttagcttccttcaaaagattattcttgtaagtatagtgcagcagatcaccaggtgatccttgatagactttgggaagaaagaatatcatcagatgatctcgtttagatgatctgggagttcacactctggactgaagctgtccccactcaccagccagatcatgctattgtattaaagctattccctagaaagcatcatttttcacccatgggatatcttccctaccatagaatttgtgaataaatttgagtaagagggttgtattctgaatcttcaaattgaggacactcaagcccccattatttctagggcaggtcactttgtcctaggtgaccagagggtttcggtgagcattttcactgttaccacaccagatacagtcccttctgatacgatcaataccattaatgacaagatcattcgaggacgtgatgagctctcccgctcccagcccctctccctcccccagcccctctccctctccccctcacacctccaccagcctctcgccggaatccactccggacccgtcgaccaactcttcggcccccaccccctcggagattgcccccagtcaggccagtcgcccgatcccccaggaggcaggacgttccaagtcctagagatggtgtgatgacgttattgatggtgactcgtcgggaggatcctcctctgcttatcattcctataaagaagctctccttcaaccttctggtcatggtggtaacgcccctgctccccctcttccccacttgaagacgaaagctggtgaccagtcagaggtgcaagggtcttctgctgaaagtcgacgtcgaaaggaggatggctggcaggtggttgagcataggaggcgccaccttcctcgtcgaggatccatagtggatctccgagggaagtgctacaagtgcctttctacctcccacctggtagcttcctgccgacgtcctacgaggtgctatcgctgcttcaagtttggccatcaagcggcaaggtgccccttgccggaagctgggcgaaagacagtgtggcagcggctgggctctggtggagatcgtactccggtgtggctgcgtttgtctggagtggacaattctggcccaacggtgatggatcgtccagtcattcagcgcaaggccccagtctggcgaaggctttcccctccagtgaactccccattagtggaaaaagaagcacagggtggcatgcttctgcctgttggacgtatgaagaagaagagaagacgttctaaacgcgggaaaggcagcttgggactgcagtcgggcccaagtcagccgcatcccaatccccctgatgctgtccagagcgccttgccgcggaaaccttcctgcgtattggagttttccactgatttggcaagaaaggaagctgctcttcggagagccttgtttgtttcggtggttggcaccaggccgatggttcgcggggatgaggtgattgaggaattggcgcgaagtttcagcatcaaccctgatgatatgtctatccagcaggccacgccggaagatttcctactattcctgcctgatgaacacacagcgacccaaattcttaacgaaggacgacctttcagaggccctggattttctctcaattttaaaagatggacaagattctctcatgcctcgacgacgtctatggcggcactggttgatattgagattcgaggaattccagctcatgcttgggatatctccacggcaaaaatgttactacaggattcgtgctgggttttggaattgttaagggattcaggaacatcatttctgctacgcgcctggtgttttgacccaaaatatctgcattcagaaatggaacttcatatcgtcgagccgggcagtgatgagcagaagaaacgatgtttgtcatacaacatttccatgacagtgtcatcggtgccctttcagatgaccaatagcactgaaactctatccccttcctctgacgatggtcagtttgatgaaggaaatgacagtgatccagctgactcccagcagcgccgccttccacctcagccacctagggaatctgttcacctttggataggcgcccagtttgtgtctggaaggagtagggcgctgtgctcggttgaggaagctgaaaggatgggcttaggcgcctcttcgggacttaatgcactgcttcaatgcggccccttgaatattgcccgacctggggagatgagatgggaatgcagctggtctgtggcgcctcgggtccttccaggcagatatgtggcgccttgggtccttccaggcggatatgcggccagccgtccattgatgcttgcgttgcccaattaaataacgcgcagctcgatgctcgggccggctccttcatatcggtggagagatcccaggagtcgccttccccttcatggaagcagtgcagacagttggctaatgaggcacgcgaccttggggtccgagctgcctcctttaaatgatgaagaaagaaccaaggtgccactagctgttgggtcgctgaatcagttgaggtcagcctcgccccagtaccatttagctgctgggccgctggagggggaccggactgattcgccccaagctactgggcctttgggatttacgggtgaagcacgccaggatgatcttgtggctgaaccggtggattgggctacgacggacctcacccatcaaatgtacatttctgagactgagaggacgaccttgactctgggcgatcatgaggttgcggacagcggaaggaagtcctcaaccgggaatttgctacaccaatccattcactgcactactggcattgaacagccagggatgctacatattaggggccttcaatcatccaaaaagctgatggtatactcacgaaaaaggttcaacagtagggacaagtctggaaatatgaatgaagaagggagtgggccaatcgcatctgtactgaggattgatactgatgaaaatacagtgtccacggtgcgagaggtcagcctagctgttactactgatgataatcagtcaacttcgcaagagacccaaacaggcagtacgcagctcaagaacaaacaattccttagcaagctctccaaaaagatttcaggcctccttgcaacaccagaagatcccccttttatgacgtctaaaaatgcccaagttgcagaaattatcccacgccgcagccgtcgaattgctggcgtgggagttgaatttgacaacatggatttatcctcaagaaccacaaagaaagttatgcaggccttgaaagtaattggggatcctggggcagtcacccagcaagccaaagaagactatctgaaagtattctccactgaacttcctatttcacatattgaagcgctggcgtccttttttggatgggtggtaccagatgatctcaaggtgggcagcattagtgttggcattagtgcctgttgagttgtcctgtagaggtcgctgatgtaagaggtttgtaatggatccaaaaaaaatcttgagctggaatgtaaggggtctcaattctacatctaggcaatgttctgttagaacttgcattgatgcttgtggcgcagacgttatctgtcttcaggaaacaaaaatgcaggaaattaacagaggaaaggtgctggctattttgggaacagattttgatcagtatgtaatgctgccgtccgagggtgctagggggggaattctgatttcctggaaaaagcatataaaggtgacagggctgaacagagtggattcttatagtatctccttgcaattccagagaaataatgggcagtcttggtggctgacttgtgtctatggacctcaaagtaattctgaaaagatcctttttcttcaagagttaaggcatttcagaagcatctgctctgagccttgggtaatagtgggagactttaatctcatctacaaggttgaagacaagaataatgataatattaatagatctatgatgggtcgcttcagaaaatttatcaatgatgttggtctgattgatactcccctaattggtcgcaaatatacctggtccaatcatcaatcttcaccaacactggtcagactggatagagttctctgcactactgattgggaagcgttgttccctaaccatctccttcaaagtgctgcttcagaggactcagatcactgcccactgattcttggacttaacagtatgtgttctggcaagcgtcgatttcatttcgaatccttttggccaaaattggaagggttccaagaggtagttctggaagcctggaattcggttaatgaaagaagttgccctttcctgacattcgaactgaaattgaaatcaactgccaaggctctgcagagatggagtgctaagaaggtaggccatgtgtcctcccagttggcacttgctagagaaattcttcatcagctggagattgcccaagactctcggctcctgtctcctttggaggtttggctcttgagagggcttaaaaaacactccttagcccttgcctccctcaaacgcactattgcccgcctacggtccagaatcagttggataaaggagggcgatgccaactctaagcttttccatatgcatgctaggcacaggcaaaggaagaactttgttgccaagattgtgtcaggggtgaacactttcactgatcacggcgagaaggctagagcagtagatgagttttatttcaaacttttgggctgcaaggcggacagatccttgactgttgatttggattacctgggtctaccttctcatgacctgactgatttagatgcgcagattgatgaaaatgaggttctggaatccataatgcaactaccttctgataaggctccggggcctgatggttacacaggcagattttataaagtttgttggccaattatcaagacggatgtgatggctgttattgctgcaatttggtgcagaaaattccagcagtttggaagacttaacactgcatttgttactcttatccctaaggagggggctgaggaagtaaaagactttcgacctatcagtctggtacacagcattgctaaacttgtcaccaagttgatggccaacagattgtcccaacgactgcatgatcttgtttctcttaggcagagcgccttcatcaagggccgtttcatccaagacaacttcatgctggttcagcagactgccagattgcttcaccagcaaggccaaccgagggttcttttgaagcttgacatcactaaagccttcgattctgtttcttggccttttttgcttgaagtacttcagagattgggtttcgggcagatttggagggatatcttaagtggccttttagcaacttcctccacacaggttttactcaatggagtttcggggaacaccatcccccacgagagggctgcggcaaggggatcccctctcccctatgctttttattttagtgatggacatccttggttgcattgtggccaaagctgatgaggaggggcagcttgagcctctctcttccaaaccactgcaccacagaatttcgctatatgctgatgacgcggttctttttttccacccaagggagagtgaaattcatactgtcctaggtattctgaatttgtttggagaagcttcaggattaaaaactaatattcagaaaagcagtgtgtatccaattcgttgtgggcaggatgagctggacatcctcaatgattggcttccttgtgaactttcgtctttcccatgcaaataccttggtctacctttgtccttaaaaaagctgtccaataatcagctgcagcccattattgacaaagtggctgatcaactttctgggtggaaagcggacctcatgacacggccaggtagaagagtgcaggttcagtacgtgatgactggcatgcttatatatctagtcatggcagttgacattcccacaggctcgctcaaagctatcgacaagatcagaaaaggatttctctggcgtgggaggaaagaggtcagaggaggacattgtttagtggcttggggaagagtttgtagacctcttgaaattggtggacttgggatttctagtcttaaagaactaggatgggccttaagaatgagatggttgtggctgcgcaaaacggatccggataagccttggtcctcattgcccatgcagatatccaacaaaataaaggcctttttctgcaccgccctgctcactgaaattggaaatgggtcctcaaccttattttggctggatcgttgggtccacggaaagaatattgaagatattgctcctcgactgcttgcagcggtaccaaaaagaattaggaacagcagaactgtgcttgaggccttgacagacaggagatggctaactgatattaaaggggccttgacagtaggtgtctttgccgatctcctagatctctgggatgaacttcaaagtgtccagcttcattcagacagggaggacaaacatattttcaggttcgctaatgatggaatttattcagcgaaagcagcttacaatggcctcttcatcgggtcgaccatggctaagtattgggaactaatttggaaaacctggtcccctcccaagtgtaaattctttttatggcttgctgatcttggaaggtgctggacagcagatcgtttgcagaagagaggtcttagccatcctgacaaatgtgtcctgtgtgaccaagagcaagaaaccatagatcacattttggtggggtgtgtttttgctaggagtttttggtttcagctgctgggacaggtcaacttatctgcctttactcctgtgatgggagaaactaaaatgatggagtggtggagcagaagcagtgagcagttacaggggattgctaaaaagggactcaattttttgattacccttgggctttggactctctggaaccacagaaatggatgtgtttttgatagagctacacctagcatggagggtgctatcagaagagctgaagaagaaattattatttggaattttgcgggggccaaacatcttgcccttattacagctcccattccaggtgtcatgtagggatctaggagtgagttcagtagttaacctcattagggaagggtgttggttggttaagtttagattgtgggggcaggttggtctagtttgctttctttcttctcctttttctttttctttttctttatatttctttttctgttgtgtttgtaattggtctaatttttagacccttcttcttaatacaatgatacgcagctctcctgcgtgttcgaaaaaaaaatatcattaatgaccgtcaccgacaccttcaaagtgcacattgcaaatatgggcattgcagagtaagtagaattgaccagaataagtcttcctgccatagataaccaggaactaatggaattgagccttctttcaactttggtgatgagagagagatagtccttgaccttcagcctcgtgaggccaattggcaaacccaaataagtgaatggaaaagtgccaatttggcatccaaacaccaccgccagctgggtggttttggtgacatcaaggttgatcaacaaaaaacatgatttgggaaaattaattttgagttctgtcgacgtgcagaacgaatgtagaattccttttaagcagaacaactccctcatcgaggccttcatgataatgagggtatcgttagcatattggatgacaaggaagttagaaggggtgatgctttcaataggagccgagagaatgtccatatctgcagctttgttgatgatgcattgaaggtccgccacaataacaaaaaggagaggtgaaaggggatcaccctgcctaacccccctcttgcaccgaattttttccccgggaggccaggataccattcaataatattgcagatgatcctgaattgagaatagcttgaacccaactgatccaattatcagggaaaccgatctgtctgtgcattgccaagatagcattgtgctcaattgtatcaaaggctttaaaaccactatttattttttggactgctgacattgatgaatatactcataagtccaagccaaacaatattgaatagatctgagtttgatgaacccatactgatttctgtggataagactcggcatcttgggctgcagtttgttggcaaggagtttggtgatcaatttgatggctatgttgaggagggaaatgggtctgtaatcattaatgttaatcaggttgctgatcttggggatcatagtaatgaaagaggtgttaagaccttcaagattggtagtcgaagaactcaagacataacttgtagaagtcatccttgatgatgggccaccaggacttcaagaatctaccattaaatctgtcagggccaggcgccttgtcagtaggcgtattctgcacaactctatcgattcaacattgtttggaaagcgcaggggaactgcgccttaaaatatattaagaagaggaaaaaaggtctatagtagaccaggattacaacatttaactccttacggaggccagtaccgcacataagtgaaagagtccaaggaagccagactcagaaaactactaaaatagaaacagtagggttcaaccatttgtcaaagaagctgccaagaaggagagacccttggccccagctaattcccaaagtcttctttcatcatcagcctgccgaaggatagaggggagactgggagtctgtccatcaaacacacatctgttacggtgattccagatcgtccaggcccctaaagagatcagcgaactcagacctttcttgaccatgccctgaactgtttcagaagctatctcccaccattccaggaaggaagtcaggcccggctggggagccaagttatccaatccgaactttctgagcagattataccagaaaatccttgcaaacacacatgagaccagcaggtgattaatagtttcaggttcttgatcacacaatggacaactgctaggatgattgagccccctttttgctaatctgtcagcagtccagcacctgttatgggccaccagccagaggaagaaacgacattttgatggagcccaagttttccaaaccctcttatagtgtccaaatgcacaggatcccaggaagagacccttgtaagctgccttcgctgaatattttccatctcgggctatactaaagatgtgtctgtcttcaatgagagggtgcagctcaaaaccagagagacagtcccagagcttaaagtaatctgccagaactccaacagtaagaccacctctaatatcataaatccatctgttgtttaacaaggcctcatgaaccgttctaatttttgctatcttctttgggattatagaaaataggctaggggcaatgatcgagatgcttttaccctgcaaccagttatcggaccagaagagggtactatgtccattacctaccatcgagacaaggactttactgaagaacgctctggctttacttggaacctgaataggaagccctgtccaaggtcttctagagtcggttttttgtagccacagccatcgcatccggagggcccatccaagttccggtagactagagatacccagtccacccagctgaagtgggcaacacaccttgccccaagccaccaaacagtgtccccctttagcttcttttcttcctctccaaagaaagccctttcttattttatctatagcatcaactgcccagtggggtatatcaattgccattgccagatacacagtcatacctgtgagtacatgttgcactagtattctcctgcctgctctggtcatcaaatcagctttccaattaggaagttggtcagcaaatttatcaacatacggctggaaatgttgcttggacagcttgtgcaaggataggggaagtcccaagtacttgcaaggaaaagctgcgatctcacaccgtagcagactttggacttccaagagagtttcttctgaacactgtatggggtagacattggatttttgcacattatttttgagaccagaggcactgccaaatagctgcaagatatcaagagtgatgggagatttcatccaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgctctgtcatcaatcagctttcatagaagtgtcagcaatttatcacatacgctgaaatgtgcttgacagctgtgcaagataggggaagtacagcaagtacttgcaaggaaaagctgcgatctcactccgtagcagactgatgacttccaagagagtcccttctgaacactgtatggggtagacattggatttttgcacattattttagagaccaggggcactaccaaatagctgcaagatatcaagagagaaggagatttctttcaccgtagggtgtaagaagagggctacatcatctgcgtaaatggagactctgtgtagctgtcttcttgctgctagctgctgcaataaacctgcctcttctgcctttataaataggtgtccaaggacatccatgaccaatatgaatagcatcggtgaaaggggatccccttgtctaagccctcttctatgctgaatttgttgtccaggaaacccattgagcatgacttgtgtggtggatgaagcaaggagaccacaaaccatgtccctccagatctgtccaaacccaaactgctgcatgacttcaattaaaaagggccaggagactgagtcaaaggccttggtgatgtcaagtttgaggagcagccgagataatctttgttgatgaaacagttttgatttctgttgtactaacatgaagttgtcctggatgaatcgccccttaataaatgcactttgatttggggaaaccaactctatcgatttcatctgtagagaacgacatagtgaggtcctctaaaccttccacgggatgaaccaagtttgcaaggttgaagatcatggtggggtcatcagagacccccatacgatccttgaacaccctctagagataggcaactttttctttatgatatgagaagctaataccttcctcattggctaaggtagcaatgacattgtgcctgtgcctgtacctgtttgttgcatcagcatgaaaaaatttagtgcattcatccccaaaagtgacctatctttcagtgtatcgttgcctccagtagctgtttttgtattttagaagcatgtcaatctgagtcttgttgattgatctcaaattatttttctgaataaacagagatctttgttcttccagtttatcaatgactaaaataacttcattacaatttgtaatcaaacggttcaagttggaggtagaagatttgctccatttcttgagatcatatcgaacattcttgaatttggcaaccactcttgcaaccctggagactgttctgacctctttattccaagcattggaaaaccacctctgaaaaacctggctcccctgaaacaggttctttctggtggaaggatgttctcaggctggttgactattttagaggccatgctatgccttgtgttgaggatggcaggacagtccttctgtggcaagaagtttggaataatatctcccccaaattcacttttccttgccttttctcttttgccaggaaaaaagatagttcggttcaagtatttttggacagcatgaatctggaacacaattttcatactcctttattcctttatcccctcaggctgctcaggaatatcaagcctttcatgagattgtcagtaacctccagaattctagagctggtaaagacaaatggacctacccgtggggcaactccactttagctcatccaagttctataatcttactttccagtcaattcagccccctgcagcctttaattggatatggcagtccaaggtcggtaagaaattcaagatctttgtgtgcctggtcttcagagatagaattaactcaaagaacatcctcagaagaaagggtttcttggcatctgacagtaactttgactgcactatgtgtgacctgcactgtgaggaggcgacttatcatctactgttttgctgtcctttcagtacgggatgctggaattatgtgggtttccaatggaatcatgatcttgatttcttctcgatgattgaagctgccaagggcgcctttggtcatagctttttcatggaaattttggccctggtggtatggtgcatatggaagtagaggaatgattttatcttcaggaatgaggctccctctttttcttctgggcgatgctgcttcaaagatatgttgaagttgtaaatgctgagatttaatccctctctggtctagttggttttgcttgccctccgggcattgtactttggtcctcttggacctttttccctctcttaatataataacgtgcagttctcctgcgcgttcgagaaaaaaatacctctcttaagtctagagtgttgctttggctaaattctcgatagctacctctctgttttctttgactccgcttgaaaccctttttttcttaagttttaataaaagcgtgctgtaggggtttcccctacagcctttccccctcaaaaaaagaaagcatcatttttgaagattttcacttgatcctacatctacaaatctgatagcatttgatgtttggctgcttatcctctttttgtgtgcaggttttttggaatttaaggatgttgagatccagtgtccacatgatggtgaacttcttgttaaagtttgtatgtctgagcattgtaaggggggaggttctggcctactctacaaatgcttgcattccagtaatggaagttgattgactgggaactgaatcaacccaagcatgtatcttgatatttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggagaggcctaaggatatcaggctttgtaattcgttttccaatggaatcatgatcttgatttcttcttttagagaaaaaacggccaagggcgcctttggtcatagctgtttcctggttaattttggccctggtggtatggtgcatatggaagtagaggaatgattttatcttcaggaatgaggctccctcttttttcttctggggcgatgcctgctttcaagaatatgttggaagtaggtaaatcgtcagatttatccctctctggtctagttggttttgcttgcccccggggctttgaactttggtcctcttggacctttttccctctcttaatataataacgtgcagttctcctgcgcgttcgagaaaaaaatacctctcttaagtctagagtgttgctttggctaaattctcgatagctacctctctgttttctttgactccgcttgaaaccctttttttcttaagttttaataaaagcgtgctgtaggggtttcccctacagcctttccccctcaaaaaaagaaagcatcatttttgaagattttcacttgatcctacatctacaaatctgatagcatttgatgtttggctgcttatcctctttttgtgtgcaggttttttggaatttaaggatgttgagatccagtgtccacatgatggtgaacttcttgttaaagtttgtatgtctgagcattgtaaaggggggaggttctggcctactctacaaaatgcttgcattccagtaatggagttgattgactgggagctgagtcaaccaagcaatgtatctgatattttctgttcatatggcatagactcagcatggaaatactttgttgaagtatgtgcctcctcccccatgtatttgttgccattggttttcgttttaacttgataaatgtttgggagcctgattgcctgctgttgcttcattttgagaattgattttacttgttatattttcagtccttgaaatcagcgactactgatactgggaggaacattcgccgggagcacttgctggttattgcagatagcttgtctgtaactgggcagttccatgcattaagcagtcaaggtttaaagcagcagcgcactcggttatcgatctcgtctccattttctgaagcatgtttttctgtaagtaccatatgatttttgtactatttctttacgtgaattgcctgtttaagtcttccaggcgtattgtgagtttatcatgcttttttcagaggcctgcacaaagttttataaatgctgcaaagcaatgttcagtggacaatctgtgtggaagtctcgatgcagttgcttggggcaaagagcctttcaatgggacgtcagggccttttgaaattatgcactcgggaaaggtgtgtatctatgattgtattcaaaacattctgccatagtgacagatgcacactattttcaacacacacttcaatgcactcccagaaagtgacgatgacaattttgagggttgatgcacatgacaccagtatttacaatactgattgtgtggagtttagtttttgcagaaagatggatgcactaactatttaatattttttcttattttcgtgcccatgtttgatgattgtgtaaggataaatgtttgacaaatagtttttgatttcttttgtgagagcattaagtgttaactctgcttgatgttttgattaattaagactggtctatccagttaacattcggtggaaggctgctgctggcactgaaaattcagctccccgcccccctccatcctcagtgatcactcctgcagaacctcgtagtcatttgcctcccgttcttcgcccgcatacagaggtcagagtagtggcgcttcctttggtcgtgatcaaggcacaaatcattatgttcagggttcgtcctcctgccatggttttcgtgaagctagctgcagggatcctcaggttgtgcagaacgtgacccttgagccaccccatggctcggtcatagctccgacgccctcctttcttggacttcctgaggccggtttgcagacgcttgagtctggccaccccacactctccactcaaggttttaccgaagatgttggtggtggtttatgcgttgtgcagaatgtgatcttggagccaccccctggttcggtcacagttccgacgcttgtatctactcacgccacaacctccgctcagggtagtctcaaagttgatgatgatctcctctgcgttaagcagaacgtgaaccttgagccaccccctggttcggtcactgttccgtcgcttgtgagtgctcagacagtccggcttgattccagagctgaaggcaggaaatccctggctggaaaaccgtttaggtctacttcaaagttgcctgctgggacttatggtattagggctggcttgcaagcatccagcatggtaactaaggtttactacagaagacggctgtgtgggaagcaggaaggttctctaatttcagagcagctgcctatgttggagcttgatggtgcatcaatggctaattctgcgcacgcgacacaacttgtgggtgatcttgtgtcatgggcatcatagggagcgatcactcatgtggggccgcacctatgcgcaccaaaagcgagaggccgcagggggcgctggcagcagcgcgcgcaaggagggcacgagcgctggcagcagcgcgcgcaaggaaggcatggcaaaggaaagcgcgtacaaggaaggcatggcaaaggaaagcgcgcgcaaggaaggcatggcaaaggaaagtgactgatttggtggctaaattgatagacctaaattgtaggggagataatttcaattagtcacttgcctaattagtggttgcctagttggtcaaccggtggcctatatataggcctgtacgcaggagacaaaggaagaaggaatatattattaaaccaatctctctctcttgcaatgactctcaagcgcctagggctgctaccctagaaccaagcctgcggcagaggggtataacctcgccggagaagacagctatccccatggaccgaagatccatgacactggaccgaaggtccatgacacctggtatcagatccaggttatcctcaccaccaccagccgcccatccctcaccaccaccagccgccgcgccatcagccgccggaagcaccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcagggggcgctgcaagcagcgcgcgcaaggagggcacggagcgctggcagcagcgcgcgcaaggaaggcatggcaaaggaaagcgcgtacaaggaaggcatggcaaaaggaaagcgcgcgcaaaggaaggcatggcaaaggaaagtgactgatttggtggctaaattgatagacctaaattgtaggggagataatttcaattagtcacttgcctaattagtggttgcctagttggtcaaccggtggcctatatataggcctgtacgcaggagacaaaggaagaaggaatatattatcaaaccaatctctctctcttgcaatgactctcaagcgcctagggctgctaccctagaaccaagcctgcggcagaggggtataacctcgccggagaagacagctatccccatggaccgaagatccatgacactggaccgaaggtccatgacatcttggctcggcggtggtttgtactgaggcgcctgattatatcaaggctatggcaagtgctgttacatctccttgcttggtggatgcttctccctcccatgttcctacttcggatgtggttgagctcactgcggctgtggtagacacttaggtgactccagctgcggtggctcccgtgtccatatgtggggggactctctctgttgagcaggaggcgcttcattcacaccaaagacaagccttccttgcgtctgtatcccggcggccttctagagttctgcctgcttctcccatacagctcttaaaatcaggcaacaagctgcccaccaaaccaattccaagacgcagtcgcagagttgctggagtgggtgttgaatttacctctgctgaccttgacagtcgtgctactaggaaaatcatgagagcagtaggcataattaccaataataatggtttggatcagagggcgcttgatgaatatgcaaatctgttcccgacacccttgtcaggctctcatataaaggctctggcagcgaacgaatcaagctgattcatcagacgccccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcaattgtggtcacatgggttacaaattgtctttttacaaacgttgatgtatctatctttataaggagtgatggttcattagctttaaagggtgtattagatgacaaactctactttagttgatttttcgaaagaggaggtcgatctagatgcatgcttaatagctaagactagtatgggctggctgtggcatcaccgtctagcacatgttgggatgaagaacctttcataaacttctaaagggagaacatgtgttaggactaaccaatgtttgttttgagaaagataggccttatgcagcatgtcaggcagggaaacaggtgggaagcactcatcacggcaagaatgtgatgacaacatcaagacctctggagcttcttcacatggacctcttcggacccgttgcctaccttagcatcgagggaagtaagtatggtctagtaattgttgatgatttttctcgcttcacttgggttttctttttgcaggataaatcagaaacccaagggaccctaaagtgctttctaaggagggctcaaaacgaatttgagctaaaggtgaaaaagataaggagcgacaacgggtctgagttcaagaacctacaagttgaggagtatcttaaggaggaaggcgtcaagcatgagttctctgctccctacacaccacagcaaaacggtgtggtagagaggaagaacaggacgcttatcgacatggcgagaatgatgcttggagagttcaagacggccgagcggttttggtcggaagctgtgaacacagcttgccatgccataaaccggctctatctgcatcaccttctcaagaagacctcctacgaactccttatcggtaacaaacccaacgtttcgtactttcgtgtatttgggagcaaatgttacattctggtgaagaaaggtagacattctaaatttgctcccaaagcagtagaagggtttttactagggtatgactcaaatacaaaggcgtatagagtcttcaacaaatcatcgggtttggttgaagtttctagcgacgttgtatttgattagactaatggctctccaagagagcaagttgatcttgatgacatagatgaagatgatgttccaacggccgcaatgcgcacgatggcgattggtgatgtgcgaccataggaacaacaggagcaagatcagccttcttcctcgacgctggtgcatcccccaacccaagatgatggacgagtacctcaagaagtggagcgtgatcaagggggagcataagaaggacaagtgatggaggaagaagcaccatgggtccctccaactcaagtccgagcgacaatccaaagaaatcaccccgtcgattagattctgagtgacataagcaagggagtaacaactcgctcacgtttagctaatttttgtgagcagtaattcgtttgtctcttctattgagcgtttcagggtagaagaggccttgcacgatccggactggggtgtttgtgaatcatcctaggcccttttggtaatgttttggtaattaatgacaactgcttgtggactaacgattcttggagaaataagaatgcagggttggaccacatagaacaggaaatgttgaagaatcatacgcattggttgtggatcagatgaagggaaaggtataatataggtttcatttttgccggtcttgaggagtttagagaagatacctgaccggattagtaggctagatagccgtactattaagaggggtcaatgacttagatctgtgtaaaacttagtgcctcatagagcatcaagtagttgcatttgcatgaggactaacagcgcttcacatttcgtaagttaaaagttctttcaaaagcatgtttgaaaattgcgaagtcatggacgcgcggactgtccgggccttgggggcggaccgtccgcgatcctccagagggggtccgaagtctgaccacttgtgtggatactttgttctattgcactgcggaccgtccgggccttagggccggaccgtccgcagtcatgaccagagaagggtggcttcgggcagtccctgaattataggcggacggtccggctgtgatgggcggacggtccgcaagtgtcaaactcgtttttggacagggactgtgtgtttttgtagatttgtactacggactgtctgggggaccagtccggacagtactgtctcaggtctcggaccgtctgggatttatagccggacggtccgcgtgtgttaacttctcttgatccgaggctcgggtgtttcaagctgccaggtcgcggacggtccggccttgaagggcggactgttcggacccaccttttgtgtcagctctgacatgtttcaaacggtcattatagccgttatatgtacggcggacagtccggccctagggcgcggacggtccgcgtgtgcgcagaactgctgccttttgcacataacagttgaattttgatgggggactataaatagaagggtagctcgtgtgagagagctctcttggccattccttgcacacattgagctcatttgtgatcctccaactcactctctcacactctttgcttgagattgcattctagtgagagattgagggttcctagtgcatttgcatcatttggtgattcttgaggcactaggtggtacaccgagcaagcgtcattggcttgttactcttggaggttgccgcctcctagacggctcgggtgattgtctccgtcgagctctccaagaagattgtggagaagccgcggtgttgattgtgaggggttcgtgcctacctcgccggagcggcaaaggtgacattagtgaaatcgaggtattgagtgatttcttgtccacttggctcaaagatcaagtcgtgtcttgatagaggagcaagtgagagcttgaagtccacctcaacgtggattaggggtgatcggcaaatcaccaataccacgggataaatttcagtgtctataccttctcgcattacttattgccttgcaattgattagtgatttgcttattgttcttcaagtattcaatctccgtagttgtttttcatacattgtttacttattgtcactagagaatttattcctcttgttgtattgattaaatttatttagtatttttgattttagttaaaaccgtctattcaccccccctctagccggtgtcctagatcctacagtgttggccatgcaggaagagctcaacaacttcaagaggaatgaagtttggagcctagtgccatgtccaaagcaaaacgttgtgggaaccaagtgggtgttccgtaacaagcaagacgagcacggagtggtgacaagaaacaaggctcgacttgtgacaaaaggttatgcccaagtcgcaggtttggatttcgaggagacttttgctcctatggctaggctagagtctattcgaatactattaccctatgccgctcaccactcttttaggttgttccaaatggacgtaaagagcgctttcctcaacgggccaatcaaagaggaggtatacgtggaacaaccccctggctttgaggatgacaggtaccccgaccatgtgtttaagctctctaaggcgcttgaaagtcgcctagagaggggggggggtgaataggcaaatctgaaatttataaactttaagcacaactacaagccggggttagcgttagaaatataatcgagtccgaaagagagggtgaaaacaaatcacaagcgaataagagtggatgacacggtgatttgttttaccgaggttcggttcttgcaaacctactccccgttgaggtggtcacaaagaccgggtctctttcaaccctttccctctctcaaacggtcacttagaccgagtgagcttttcttctcaatcaattgggacacttagtccccacaaggaccaccacacaattggtgtctcttgctttgattacaaagaacttgggaacaagaaatggggaagaagaaaagcgatccaagcgcaagagctcaaaagaacacgacaaaactctctcttctagtcactattgctttgagtggaattgggacttggagagattttgattcactctatttgtgtcttgtattgaatgcactagctcttgtattgaatgtgttggttgaaaacttggatgccttgaagtgttggtggttgggggtatttatagccccaaccaccaaagtggtcgttggggaaggctgctgtcgaagggcgcaccggacagtccggtgcgccaccggacactatccggtgcgccagccacgtcacccaaccgttagggttcgaccgttggagcttctgacatgtgggccaccggacaggccggtggtgcaccggacaggtcctgttcactgttcgatgcaccatctagcgcctgctctgactttgcgcgcgcagtcggcactgttcactgttcacttttgtagtcgactgttggcgctgtagccattactctgcttgacacaccggacagtccggtgaattatagcggagaggcaatcccagaaacccgaaggtggcaagttcggagttgatctccttggtgcatcagacactgtccggtgccacaccggacagtccggtgtgccagaccagggcagccttcggttgtcttttgctctttttatttgaaccctttcttggactttttattggtttgtgttgaacctttggcacctgtagaacttataatctagagcaaactagttagtccaataatttgtgttgggcaattcaaccaccaaaatcatttaggaaaaggtgtgagcctatttccctttcaatctccccctttttggtgattgatgccaacacaaaccaaagcaaatatataagtgcagaattgaactagtttgcataaggcaagtgcaaaggttgcttggaattaaaccaatatacatttcataagatatacatggatgctttcttcatatttaacattttggaccacgcttgcaccacttgttttgtttttgcaaactctttttggaaaaaaatttcaaagtctttttgcaaaaagtcaaaggtaaatgaaaaagatttcgagaagcatttttaagatttgaaattttctccccctgtttcaaatgctttttctttgactaaacaaaactccccctcaatgaaattctcctcttagtgttcaagaggattttagattttagataataattttgaagaggttataccaacgaatcaagctgaatcatcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttgatgaatcagcttgattcgttgattgtctccgtcgagctctccaagaagattgtggagaagccgcggtgttgattgtgaggggttcgtgcctacctcgccggagcggcaaaggtgacattagtgaaatcgaggtattgagtgatttcttgtccacttggctcaaagatcaagtcgtgtcttgatagaggagcaagtgagagcttgaagtccaccttaacgtggattaggggtgatcggcaaatcaccaataccacgggataaatttcagtgtctataccttctcgcattacttattgccttgcaattgattagtgatttgcttattgttcttcaagtattcaatctccgtagttgtttttcatacattgtttacttattgtcactagagaatttattcctcttgttgtattgattaaatttatttagtatttttgattttagttaaaaccatctattcacccccccccctctagccggtgtcctagatcctacagtgttggccatgcaggaagagctcaacaacttcaagaggaatgaagtttggagcctagtgccatgtccaaagcaaaacgttgtgggaaccaagtgggtgttccgtaacaagcaagacgagcacggagtggtgacaagaaacaaggctcgacttgtgacaaaaggttatgcccaagtcgcaggtttggatttcgaggagacttttgctcctatggctaggctagagtctattcgaatactattaccctatgccgctcaccactcttttaggttgttccaaatggacgtaaagagcgctttcctcaacgggccaatcaaagaggaggtatacgtggaacaaccccctggctttgaggatgacaggtaccccgaccatgtgtttaagctctctaaagcgcttgaaagtcgcctagagagggggggtgaataggcaaatctgaaatttataaactttaagcacaactacaagcccggggttagcgttagaaatataatcgagtctgaaagagagggtgaaaacaaatccacagcgataagagtggatgacacgtgatttgttttaccgaggttcggttcttgcaacctactccccgttggaggtggtcacaaagaaccgggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacaaggtccaggtcactgttcgatgcaccaatctagcgcctgctctgactttgcgcgcgcagtcggcactgttcactgttcacttttgtagtcgactgttggcgctgtagccattactctgcttgacacaccggacagtccggtgaattatagcggagaggcaatcccagaaacccgaaggtggcaagttcggagttgatctccttggtgcatcagacactgtccggtgccacaccggacagtccggtgtgccagaccagggcagccttcggttgtcttttgctctttttatttgaaccctttcttggactttttattggtttgtgttgaacctttggcacctgtagaacttataatctagagcaaactagttagtccaataatttgtgttgggcaattcaaccaccaaaatcatttaggaaaaggtgtgagcctatttccctttcaatctccccctttttggtgattgatgccaacacaaaccaaagcaaatatataagtgcagaattgaactagtttgcataaggtaagtgcaaaggttgcttggaattaaaccaatatacatttcataagatatacatggatgctttcttcatatttaacattttggaccacgcttgcaccacttgttttgtttttgcaaactctttttggaaaaaaatttcaaagtctttttgcaaaaagtcaaaggtaaatgaaaaagatttcgagaagcatttttaagatttgaaattttctccccctgtttcaaatgctttttctttgactaaacaaaactccccctcaatgaaattctcctcttagtgttcaagaggattttagattttagataataattttgaagaggttataccaatttgaaattctatcaaaaataagataccaattgaaaaaccttcttttaatgcaaatttgaaagactatatttttgaaattgctggtggtgcggtccttttgctttgggctaatactttctcccccttaggcatgaatccccaaaaacggatacttgtgagtgaaatataagcccttttcaaactatctctccctatggcaaacaatatatgagtgaagattataccaactttagagagcggtgcggagtgacggcgaaggatgaataatacgatggagtggagtggaagccttgtcttcgccgaagactccatttccctttcaatctatgacttatcatgaaatacacttgaaaaccacattagtcatagcacatgaaagagatatgatcagaggtatataaataagctatgtgtgcaaaatatcaatcaaaattcctagaatcaagaatgtttagctcatgccttagtttggtaaaagttttctcatctagtggtttggtaaagatatcggctaattgttctttggtgctaacataagcaatctcgatatccccccgttgttggtgatccctcaaaaagtgatatcgaatggctatgtgcttagtgcggctgtgctcaatgggattatccgccatgcggattgcactctcattatcacataggagagggactttggttaatttgtaaccatagtccctaagggtttgcctcatccaaagcaattgcgcgcaacaatggcctgcggcaatgtactcggcttcgacggtagaaagagctacagaattttgcttctttgaagcccaagacaccagggatcttcccaagaactgacaagtccctgatgtgctctttctatcaattttacaccctgctcaatcagcatctgaataaccaattaaatcaaatgtggatcccttggggtaccaaaggccaaacttaggagtatgaactaaatatctcaagattcgttttacggccctaaggtgaacttccttaggatcggcttggaatcttgcacacatgcatacggaaagcataatatccggtcaagatgcacataaatagagtaaagatcttatcatcgaccggtataccttttgatctacggatttacctctcgtgtcgaggtcgagatgcccattggttcccatgggtgtcttgatggacttggcatccttcatcccaaacttggtgagtatgtcttgaatgtactttgtttggctgatgaaggtgccctcttggagttgcttcacttgaaatcctaagaagtacttcaactcccccatcatcaacatctcgaatttttgaaccattatcctactaaattcttcacaagtagatttgttagtagacccaaatatgatatcatcaacataaatttgcatacaaacaaatcatttgtaatagttttagtaaagagagtaggattggcttttccgactttgaagccattagcgataaggaaatctcttaggcattcataccatgctcttggggcttgctggagccgataaagcgccttagagagtttataaacgtgattagggtactcactatcttcaaagctgggaggttgctcaacatagacctcctccttgattggtccattgaggaaggcacttttcacgtccatttggtaaagcttaaagccatggtaagtagcataggcaagtaatatgcgaattgactcaagcctagctacgggtgcataggtttcaccgaaatccaaaccttcgacttgtgaatatcccttggccacaagtcaggctttgttccttgtcaccacaccatgctcatcttgcttgttgcggaaaaccactttgttcctacaacattttggttaggacgtggaacaatatgccaaacctcattcctcgtgaagttgttgagctcctcttgcatcgccaacacccaatctgaatctcttaatgcatcttccaccctgtatggctcaatagaaaacacaaaagagtaatgttcacaaaaatgagcaacacgagatcgagtggttacccccttatgaatatcgtcgaggatggagttcacagggtgatctcgttgtattgcttggtggactcttgggtgtggcggtgcgggacccttatcatcttccttgtcttgatcattggcatctcccccttgatcattgtcctcctcttgaggtggctcttcttgatcttcattttcaccatcttgagcttgatccttatcttgggttggtgaagatgcttgatttgaagatgatggttgaccttgtgcatgtggaggctcttcggattccttaggacacacatccccaatagacatgttccttagcgcgacgcatggagcatcttcatcatctaactcatcaagatcaacttgctctacttgagagccgttagtctcatcaaacacaatgtcacaagaaacttcaactagtccagtggacttgttaaagactctatatgcccttgtgtttgaatcataaccaagtaaaaagccttctacagccttaggagcaaatttagattttctacctcttttaacaagaataaagcatttgctaccaaagactctaaaatatgaaacattgggctttttgccagtaaggagttcatacgatgtcttcttgaggattcggtgaaggtagagacggttgatggcgtagcaagaagtgttgactgctttcgcccaaaaccggtccgaagtcttgtactcatcaagcatggtcctcgccatgtcaagtagagttctattcttcctctctactacaccattttgttgtggtgtgtagggagaagagaactcatgcttgatgccctcatcctcaaggaagccttttttttgtgagttcttgaactctgtttcattgtcgcttctaatctttttgatccttaagccgaactcattttgagcccgtctcaagaatccctttaaggtctcttgggtttgtgatttttcctgtaaaaagaacacccaagtaaagcgagaataatcatccacaataacaagataatacttactcccgccgatgcttatgtaagctatcgggccgaataggtccatgtggagtagctcaagcggcctgtcggtcgtcatgatgttcttgtgtggatggtgaacaccaacttgctttcctacttgacatgcgctacaaatcctgtctttctcaaaatgaacatttgttagtcccaaaatgtgctctccctttagaagcttatgaagattcttcattccaacgtgggctactcgacgatgccagagccaacccatgttagtcttagcaattaagcaagtatcgagttcagctctattaaaatcaactaagtatagctgacccttgagtactcccttaaatgctactgaatcatcacttcttctaaagacagtaacacctatatccgcaaaaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattttttttaaaaggcttttttccccacccttttcgggttccaaaagaaaaaccccaaaaagaagtaaatgttcacaaaaaaatggagcaaccccggaggatggaggtggtttacccccctttatggaaattttgttggaggattggaggttccaccggggggaatcttggttggtattggcttggtgggcactccttggggggggggcgggttgcggggaccccttatcatttttccttgttcttggatccattgggcatctccccccttgatccattgtccctccttcttggaggtggctctttcttgatcttcatttttcaccatcttgagcttgatccttatcttgggttggtgaagatgcttgatttgaagatgatggttgatcttgtgcatgtggaggctcttcggattccttaggacacacatccccaatagacatgttccttagcgcgacgcatggagcatcttcatcatctaactcatcaagatcaacttgctctacttgagagccgttagtctcatcaaacacaatgtcacaagaaacttcaactagtccagtggacttgttaaagactctatatgcccttgtgtttgaatcataaccaagtaaaaagccttctacagccttaggagcaaatttagattttctacctcttttaacaagaataaagcatttgctaccaaagactctaaaatatgaaacattgggctttttgccagttaggagttcatacgatgtcttcttgaggattcggtgaaggtagagacggttgatggcgtagcaagaagtgttgactgctttcgcccaaaaccggtccgaagtcttgtactcatcaagcatggtcctcgccatgtcaagtagagttctattcttcctctctactacaccattttgttgtggtgtgtagggagaagagaactcatgcttgatgccctcatcctcaaggaagccttctatttgtgagttcttgaactctgtttcattgtcgcttctaatctttttgatccttaagccgaactcattttgagcccgtctcaagaatccctttaaggtctcttgggtttgtgatttttcctgtaaaaagaacacccaagtaaagcgagaataatcatccacaataacaagataatacttactcccgccgatgcttatgtaagctatcgggccgaataggtccatgtggagtagctcaagcggcctgtcggtcgtcatgatgttcttgtgtggatggtgaacaccaacttgctttcctacttgacatgcgctacaaatcctgtctttctcaaaatgaacatttgttagtcccaaaatgtgctctccctttagaagcttatgaagattcttcattccaacgtgggctactcgacgatgccagagccaacccatgttagtcttagcaattaagcaagtatcgagttcagctctattaaaatcaactaagtatagctgacccttgagtactcccttaaatgctactgaatcatcacttcttctaaagacagtaacacctatatccgcaaaagacagttgtaacccattttgcatatttgagaaacaaaaagcaagttataatctaaagatctacagaaaaacattggaaatagaatggtcatgaggatatagcaattttaccaagtcctttgaccaaaccttgatttccatccccgaatgtgataactctttggggatcatggtttttctcataggaggagaacatctttttctccccagtcatgtggtttgtgcacccgctatcaattatccaacttgagcccccggatgcataaacctacaaaacaaatttaggccttcttcttaggtacccaaacggtcttgggtcctttcacattagaaacaagcaccttgggtacccaaacacaagtctttgatcccttgtgtttggccccaacatatttggcaactactttgcctgatttgttagtgagaacataagaagcatcaaaagtcttgaatgaaatattaagttcatttgatgctattggagatttctttttaggcaatttaacatgggttgattgcctagagctagacgcctcactcttatacataaaagcatgatgagagccagagtgagacttcctagagtgaattctcctaattttgtgttcaggataaccgacagggtataaaatgtaaccctcgttatcctgaaccatgggagccttacccttaacaaaattagacagtttcttaggggcactaagctcgacattgtctccctgttggaagccaatgcaatccttaatgctaggacgtctcccactatagagcatgcttctagcaaatttaaatttttcattttctaagtcatgctcattaatcttagcactaagttgagctatgtgatcattttgttgtttaattaaagctaggtgatcatgaatagcatcaacattaatatctctacatctagtacaaatagtaacatgctcaatggtagatgtagagggtttgcaaacatttaattcatcaatcttagcatgtaacaaaacatttttatttctaagattggaaataacatcattgcaaacatttaaatctttagccttagcaattaatttttcattctcaattttaaggctagagagagatgcattcaatttgtcaatcttagtaatcaaactagcattatcatttctaagactaacaattgaatcatcacaaacatctaacttctcaaccttagcaattaatttggcattttcatttctaaggtttgagataacatcatggcaagtgcttagctcactagttaatttttcacatttttctacttcctgagcataatcatttttaaccttaacatgcttcttattttctttaattaggaagtcctctttgctatccaagagttcatccttctcatgaatagctcctatcaattcatttaatttctctttttgttgcatgttgaggttggcaaaaagggaaagtaaattatcctcatcatcactagagttctcctcatcactagatgttgcatatttagtggaggctctagattttaccttctttttgccgtcccttgccttgaggcacttgtggccgacgttggggaagagaagacccttgttgacggcgatgtttgcgacgtcctcatcggaggaggagtcggtggagctctcatcggagtcccactcccggcaaacatgggcatcgccgcccttcttcttgtaatacttcttcttctcctttcttctccctttcttgtcgtcgcccctgtcactatcacttgataatggacatttagcaatgaaatgaccgggcttaccacacttgtagcacaccttcttggaacggggcttgtaatctttccccttcctttgcttgaggatttggcaaaagcttttttaaagccatctcctcattgtcgagcttggagtcatcgatgggaagcctactcgatgtagactattccttcttctcctccgtcgctttgaaggcgacgggttgcacctcgggtgtggaggtggcgcctcgctcgatgatttgtttggagcctttgatcattagctcaaagctcacaaactttcctatcacttcctcgggagacattagtttatatctaggatcaccacgaattaattgaacttgagtcggattaagaaatacaagtgatcttagaataaccttgaccatttcatggtcatcccatttggtgctcccgaggttgcgcacttggttcaccaaggtcttgagccagttgtacatggcttgtggctcctccccttggtgaagcatgaatcgactgagctccccctcgatcgtttcccgcttggtgatcttggtcacctcgtctccttcgtgcgcagttttgagtacgtcccaaatctccttggcactcttcaacccttgcaccttgttatgctcctctcgacttagagaggcgaggagtatagtagtggcttgggagttgaagtgccggatttgggctacctcgttcgaatcatagccttcatcccccatggatggttcctgcgcaccaaactcaacaatgtcccaattgctagcgtggagtgaggttagatggtgcctcattttatcactccacatacaataatcttcaccattaaaaaccggtggtttgcctagtgggacagaaattaaaggagtgtgtttggaaatgcgaggatagcgtaaggggatcttactaaacttcttgcgctcatggcgcttagaagtgacggacggcgcgtcggagccggaggtggaaggcgacgaagaatcggtctcgtagtagaccactttcttcattttcttctacttgtcgccactccggtacgacttgacgcggagaggtgattcctccctcttcttgttgtcggattctcccgatggagccttcccgtggcttgtggcgggcttctcgccggtcaccatctccttcttggcgtgagctcccgacataacttcgagcggttaggctctaataaagtatcgggctccgataccaattgaaagtcgcctagaggtggggtgaataggcaaatctgaaatttataaactttaagcacaactacaagtcggggttagcgttagaaatataatcgagttcgaaagagagggtaaaaacaaatcacaagcgaataagagtggatgacatggtgatttgtttttaccgaggttcggttcttgcaaacctactccccgttgaggtggtcacaaagaccgggtctctttcaaccctttccctctctcaaacggtcacttagaccgagtgagcttttcttctcaatcaaatgggacacttagtccccacaaggaccaccgcacaattggtgtatcttgctttgattacaaagaacttgggaacaagaaatggggaagaagaaaagcgatccaagcgcaagagctcaaaagaacacgacaaaactctctcttctagtcactattgctttgagtggaattgggacttggagagattttgattgactctatttgtgtcttgtattgaatgcactagctcttgtattgaatgtgttagttgaaaacttggatgtcttgaagtgttggtggttgggggtatttatagccccaaccaccaaagtggccgttggggaaggctgctgtcgaagggcgcaccggacagtccggtgtgccaccgaacactatccagtgcgccagccatgtcacccaaccattagggttcgaccgttggagcttctgacatgtgggccacctgacagtccggtggtgcaccggacaggtcctgttcactgtccggtgcgccatctggcgcctgctctgactctgcacgcgcagtcggcactgttcactgttcacttttgcagtcggccattggcgttgtagccgttactccgcttgacacatcggacagtccggtgctacaccggacagtccggtgaattatagcggagaggcaatcctagaaacccgaaggtggcaagttcggagttgatatccctggtgcaccggacactgtccggtggcacaccagacagtccggtccgctagaccagggcagcctttggttgtcttttgctctttttatttgaaccctttcttggactttttattggtttgtgttgaacctttggcaccagtagaacttataatctagagcaaactagttagtccaataatttgtgttgggcaattcaaccaccaaaataatttaggaaaaggtgtgagcctatttccctttcagcactctatggactaaagcaagccccaagagcatggtatgaatgcctagagatttcttaattgctaatgctttcaaggttgggaaagccgatcctactcttttcactaagacttgtgatggtgatctttttgtgtgccaaatttatgtcgatgacataatatttggttctactaaccaaaagtcttgtgaggagtttagcagggtgatgactcaaaagtttgagatgtcgatgatgggtgagttgaactacttccttgggttccaagtgaagcaactcaaagacgacaccttcatctcccaaacgaagtacacacaagatcttctcaagcggtttgggatgaaggatgccaagcccgcgaagacaccgatgggaaccgacgggcatgttgacctcaacaaaggaggtaagtccattgatcaaaaggcataccggtccatgataggttcattgctttatttatgtgctagtagatcggacattatgctaagtgtatgcatgtgtgctagatatcaatccgactccaaggaatgtcaccttgtggccgttaagtgaattcttagatatttagtttctacgccttacttcgggatctggtatctaaaggggtctacctttgacttgattggatattcagactccgattatgctagatgcaaggttgataggaagagtacattagggacgtgccaattcctaggaaggtccctggtgtcttggagttcaaagaaacaaacatctattgccctatccaccgctgaggccgagtatgttgccgtaggacagtgttgcgcgcaactactttggatgaggcaaaccctccaggactttggctacaatctgagcaaaatcccactcctatgtgacaatgagagtgcaatccgcatggcggataatcctattgaacacagttgcactaagcacatagacattcagcatcactttctgagagaccaccagcaaaagggagatatcgaagtgtaccatattagcaccgagaaccagctagttgatatctttaccaagccgttggatgagaaaagcttttgcaggttgcgtagtgagctaaatgtcttagattcgcgtaacttggattgatctatagcatgcatgtgttttatgcctgtgatcatgttactttgaagcatttacattaattgtcatatgtttgtggtgctcaagttgtacatgacctcccagacctcacaagtccatatgcaaatggtgcacatatttagggggagaagtgctacaacttgaccctttgagactaacctttgtgtttgagtatacttgatgtagtctcaaaggagcattgaaagggaaaggtgaacttggaccatgcaaagacttccactgcactccggtattagtgtactcacctccaagttcatacttatactctcattgcctttttgctcttaattgacatttttggtgaggcaaaggggttaaagtgccaataaataattctgtttttggtgcttaatgccaaagggggaataaattaaaggccaaaagcaaatggttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcattcccaccaccaaatatttaggaaaggtgggagctatttcctttcagcactcatggactaaagcaagcccaagagcatggtatgatgcctagagatttcttaattgctaatgctttcaggttgggaaagccgatcctactcttttcactaagacttgtgatggtgatctttttgtgtgccaaatttatgtcgatgacataatatttggttctactaaccaaaagtcttgtgaggagtttagcagggtgatgactcaaaagtttgagatgtcgatgatgggtgagttgaactacttccttgggttccaagtgaagcaactcaaagacgacaccttcatctcccaaacgaagtacacacaagatcttctcaagcggtttgggatgaaggatgccaagcccgcgaagacaccgatgggaaccgacgggcatgttgacctcaacaaaggaggtaagtccattgatcaaaaggcataccggtccatgataggttcattgctttatttatgtgctagtagatcggacattatgctaagtgtatgcatgtgtgctagatatcaatccgactccaaggaatgtcaccttgtggccgttaagtgaattcttagatatttagtttctacgccttacttcgggatctggtatctaaaggggtctacctttgacttgattggatattcagactccgattatgctagatgcaaggttgataggaagagtacattagggacgtgccaattcctaggaaggtccctggtgtcttggagttcaaagaaacaaacatctattgccctatccaccgctgaggccgagtatgttgccgtaggacagtgttgcgcgcaactactttggatgaggcaaaccctccgggactttggctacaatctgagcaaaatcccactcctatgtgacaatgagagtgcaatccgcatggcggataatcctattgaacacagttgcactaagcacatagacattcagcatcactttctgagagaccaccagcaaaagggagatatcgaagtgtaccatattagcaccgagaaccagctagttgatatctttaccaagccgttggatgagaaaagcttttgcaggttgcgtagtgagctaaatgtcttagattcgcgtaacttggattgatctatagcatgcatgtgttttatgcctgtgatcatgttactttgaagcatttacattaattgtcatatgtttgtggtgctcaagttgtacatgacctcccagacctcacaagtccatatgcaaatggtgcacatatttagggggagaagtgctacaacttgaccctttgagactaacctttgtgtttgagtatacttgatgtagtctcaaaggagcattgaaagggaaaggtgaacttggaccatgcaaagacttccactgcactccggtattagtgtactcacctccaagttcatacttatactctcattgcctttttgctcttaattgacatttttggtgaggcaaaggggttaaagtgccaataataattctgttttggtgcttaatgccaaagggggagaaattaaggccaaagcaaatggatcagctaccacttgtgaatttttgaaaacaatagagttagaacttttgatttgtccaaaatactcttattgcaaaatttggtctcttgtgggggagaattttgattatgggaaaagggggagtttttggcacttgatcaatttcactcttggattatctctctttatgcccaaacaagtgagtttgacttagagataagaaaatgaatttgatttgcaaaaacaaacaaagtggtggcaaagaatgatccaaatatgccaaattatagtcaaaaacaatttggtcctcattttgcattgatgttgcacttattttggttgctttttgatgtgttggcataaatcaccaaaaagggggagattgaaagggaaatgtgccctgggccatttttataatgttttggtgattaagtgtccaacacatagtaagtgagacgaatctctagaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttttgatgaggcaaaccctcccaggactttggctacaatctgagcaaaatcccactcctatgtgacaatgagagtgcaatccgcatggcggataatcctattgaacacagttgcactaagcacatagacattcagcatcactttctgagagaccaccagcaaaagggagatatcgaagtgtaccatattagcaccgagaaccagctagttgatatctttaccaagccgttggatgagaaaagcttttgcaggttgcgtagtgagctaaatgtcttagattcgcgtaacttggattgatctatagcatgcatgtgttttatgcctgtgatcatgttactttgaagcatttacattaattgtcatatgtttgtggtgctcaagttgtacatgacctcccagacctcacaagtccatatgcaaatggtgcacatatttagggggagaagtgctacaacttgaccctttgagactaacctttgtgtttgagtatacttgatgtagtctcaaaggagcattgaaagggaaaggtgaacttggaccatgcaaagacttccactgcactccggtattagtgtactcacctccaagttcatacttatactctcattgcctttttgctcttaattgacatttttggtgaggcaaaggggttaaagtgccaataataattctgttttggtgcttaatgccaaagggggagaaattaaggccaaagcaaatggatcagctaccacttgtgaatttttgaaaacaatagagttagaacttttgatttgtccaaaatactcttattgcaaaatttggtctcttgtgggggagaattttgattatgggaaaagggggagtttttggcacttgatcaatttcactcttggattatctctctttatgcccaaacaagtgagtttgacttagagataagaaaatgaatttgatttgcaccaaaagcgagaggccgcagggggcgctggcagcagcgcgcgcaaggaaggcatggcaaaggaaagcgcgtacaaggaaggcatggcaaaggaaagcgcgcgcaaggaaggcatggcaaaggaaagtgactgatttggtggctaaattgatagacctaaattgtaggggagataatttcaattagtcacttgcctaattagtggttgcctagttggtcaaccggtggcctatatataggcctgtacgcaggagacaaaggaagaaggaatatattatcaaaccaatctctctctcttgcaatgactctcaagcgcctagggctgctaccctagaaccaagcctgcggcagaggggtataacctcgccggagaagacagctatccccatggaccgaagatccatgacactggaccgaaggtccatgacacctggtatcagatccaggttatcctcaccaccaccagccgcccatccctcaccaccaccagccgccgcgccatcagccgccgcaacgccctcccacccgccctctccaactctagatgcgttcactcggctcaaagagagttttggccgcttcgcagagcagtgggatcagttcgttgtgatgttccaccgctacaaggagaagacagagaaggaactccaagcagcggtgcggcttcagacggcagcgcgagggttcctggcacgccgccaggtacagtcccttcgtggggagaagcaccttgctgtggcctccagggccaccccatggccgtcatcacatgagcaggccgtggtgcgcctgcaagccacagtgcgcggcttccttgttaggcgggcggtgcggaagctgcacttgctgatcagctcatcgctgcaccaactcgcagcctgcgcacccaaccaccaggtctcgtctatactttttgaaccccctgcagaagtcgagatctaggtatgcaacccccctgcacggccaaagagggtcgtctccttcattcgggcacctgccttggtgctggacagacccaacataagaacaggctggttcctcctccacctttcatccaacgtgaaggccgcagttcagctctttccttgggatccaggaggacaggaggacatagctgcagttcaaatttaaattttagttccacaattattttgtattttcgtcttaaataataaaggtaagccgagatgtaaaaggcttaaccttaagtcatgttaggtaagtctatggcagctcgaggacgagctggtcctcaagggagggggagatgtcatgggcatcatagggagcggccactcatgtggggccgcacctatgcgcaccaaaagcgagaggccgcagggggcgctggcagcagcgcgcgcaaggagggcacgggcgctggcagcagcgcgcgcaaggaaggcatggcaaaggaaagcgcgtacaaggaaggcatggcaaaggaaagcgcgcgcaaggaaggcatggcaaaggaaagtgactgatttggtggctaaattgatagacctaaattgtaggggagataatttcaattagtcacttgcctaattagtggttgcctagttggtcaaccggtggcctatatataggcctgtacgcaggagacaaaggaagaaggaatatattatcaaaccaatctctctctcttgcaatgactctcaagcgcctagggctgctaccctagaaccaagcctgcggcagaggggtataacctcgccggagaagacagctatccccatggaccgaagatccatgacactggaccgaaggtccatgacatcttggctcggcggtggtttgtactgaggcgcctgattatatcaaggctatggcaagtgctgttacatctccttgcttggtggatgcttctccctcccatgttcctacttcggatgtggttgagctcactgcggctgtggtagacacttaggtgactccagctgcggtggctcccgtgtccatatgtggggggactctctctgttgagcaggaggcgcttcattcacaccaaagacaagccttccttgcgtctgtatcccggcggccttctagagttctgcctgcttctcccatacagctcttaaaatcaggcaacaagctgcccaccaaaccaattccaagacgcagtcgcagagttgctggagtgggtgttgaatttacctctgctgaccttgacagtcgtgctactaggaaaatcatgagagcagtaggcataattaccaataataatggtttggatcagagggcgcttgatgaatatgcaaatctgttcaagacacccttgtcaggctctcatataaaggctctggcagcgctgtttggctggcagcctcctgaagacatgtagttgctccctttgtcttcttcggtcgctccctgcacccttaagataaatggatccagaacgtgttctaatctggaatgttcgaggattaaactccccagctaggcaagcttctgttcgttccttagttgattcggctagaatagatatcgtctgtttgcaagaaaccaaaatggatgttattagtcgtggaaccctcctttctgccttgggttctaattttgatcgccatatcgagctccctgctgttggtctctggaatgaattctggtggcttggaagcactgagtggataccactggaggacgaatctctagctatgcagggaacttggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctggatagatgcggtagtttgaagcgcctgataattcggtatggcagtgctgtgatttcatgcgacgggggcctctactgccttctctactccggagcgtttgtctgatcgcgagctggtggacgttagcgactccagctgcggtttctcccggacctccagcggggggactctatcatttgaacaggacgcgcttcattcacgccaaagacaagcctaccttgcgtctgctcccggcgcccctctaaaagtctgctcgcttctcccatacagctcttaagtcagccaacaagctgcccaccaaaccattccaagacgcagtcgcagagttgctggagtgggtgttgaattaacctttgctgaccttgacagtcgtgctactaggaaaatcatgagagcagtaggcataattacccataataatggtttggatcagagggcgcttgatgaatatgcaaatctgttcaagacacccttgtcaggctctcatataaaggctctggcagcgctgtttggctggcagcctcctgaagacatgtagttgctccctttgtcttcttcggtcgctccctgcacccttaagataaatggatccagaacgtgttctaatctggaatgttcgaggattaaactccccagctaggcaagcttctgttcgttccttagttgattcggctagaatagatatcgtctgtttgcaagaaaccaaaatggatgttattagtcgtggaaccctcctttctgccttgggttctaattttgatcgccatatcgagctccctgctgttggttccagcgggggaattctggtggcttggaagcactgtgtggataccactggagagttgtatgtgcggaataatagtgtctcggtgcagttatgcaattgcaatgggagaacttggtggctcacttgcgtgtatggaccacagggaaatagtgaaaaagtcctttttttgcaggagcttagggacctgagattgctgtgtcatggcccttggatgattgatggtgatttcaacatgatctataaagctgaagataagaataatactaacataaaccaagttatgatgggaagatttcgtagcttcatcaatgatcttgccctaagtgagctccctttaattggtcggaaattcacttggtctagtcagcagaatcccccaaccctagtgaaacttgacagagtattatgcacattagactgggtggatttatttccaaattccttgcttcagagttctgcctcaaatgactcagaccactgccccctccttttgggcctgaatgataatagtatggcaggaaggcgccgatttcattttgagtccttttggcctaagtttgagggatttctggaggctgtttcgttggcttggcattctgttccagctgtgcagtgtccttttgcaactttgaactctaaactgaaagctactgctcgtgggctgcaggcttggagtgctaaaaaggttgggcatatttcagcctctttagcccttgcccgtgtgctcctgcaccagttggaaattgctcaagacagtcgtggtctttcctcagctgagctttggtttctcttatgccttaagaaacactcccttgctctatcttctcttcgaaggacaattgccaggcttcgttccagaattgggtggctgcgtgagggtgatgctaataccaaattattccacatgcattcaagattccgcaagaagaagaattttgttcctaaattagtctctaatggtgctgtccttaccggccatgatgccaaggctgatctggtcaatgaatcccacatggatccggaaaaaataattgtttggaatgttagaggtcttaattctctagctcgacagaattctgtttgtgagctccttaattgttatggagcggatataatctgtcttcaagaaactaagatggcacaaccttctccgcgtgctctcctctctatgttggggtctgattttaccggttcattggccctgccttctaatggttcgaggggtggaatccttattgcttggagacgacacttggggataactggagctaccaggacagacatccatagtatttctgtgcagttttgttcagtggagggacaccagtggtggcttacttgtgtgtatggacctcaatctaatgaagccaagattgaatttctgcaagagctgagacatattagagcagcttgtcagggtccttggatgattactgggatttcaatctcattttgcatgccgaggataaaaacaactcacatattaatcgggctatgatgggtcgattcaaaaaattggtagatgatctcgctcttaaagaaattccactccatgggcgcaagtttacttggtctaatcagcagaatcaacccactcttgtcaaacttgatagagtcctgtgctctattgattgggaggagctgtttcctggtgcagtgttacaaagtgcggcttctgaagattctgatcactgtcctttattattgggtctcaaagattgcaaaggtgttaaaaggcgcttccattttgaatcattctggacgaaaattgaagggttccacgatgtggtgcacaacgcctggaattcggttcctgttggccactgccccttctccacttttgatttaaaactcaaagggacagccaaagcccttcaaggatggagcagcaagaaggtggggcacattgagactcaactgcatcttgctagagatttgatccatcaacttgagattgcgcaggatggtcgtattctgtctgtgttggaaaggtggctgttaagtaaattgaagaagctcgctctggctttggcctcaaccaagcgtaccattgcccgccttagatcaagaatttcttggctcaaggaaggagatgcaaattctaagttgttccattcctttgcacggtacagaaagaagaaaaatagtgtatccaagcttactgttggaaatcaagtccttactgctcataatgacatagctgcagcagtggatcagttttactttgatttaattggggctagtaaagacagaaatatttcgattaaccttgaggctctggaaactgctggcactccatctccaaatttgatcgagttgaacagccccattactgagcaagaagtgtgcaatgctataaattctctgccctctgataaatctcctggaccagatggatttactggtagattttacaaaatttgctggtccattattaaagaggatcttatggctgcggtgattgcgatttggaacagaaaatttgataattttcataagctgaattctgcttttatcattctaatcccaaagaaagataatgctgatcaagtcaaagattttagacctatcagccttgttcacagctttgcaaaactaatcacaaagatattggcttctcgattggcttcaaggctcaacgatttggtctctccaaaccaaaatgccttcattaagggtcgctttatccaggataatttcatgttggttcagcagacggctaaattacttcatcaacaaaggcatccttgcctgatgctcaagctggatattactaaagcttttgattcggtttcctggcccttccttattgaggtcatgcagaatctagggtttgggcagatctggagagatatcattttagggctgcttctcacttcctctactcgagtgttagttaatggtcatccgggaagcataatttctcatagaagagggctgcgacagggggatcctctttctccgatgctgtttgtgcttgtcatggatgtgcttggtcaacttgtctctaaagcagatgaggaaggtttattacaacctctttctactaggcagcttcaacaccgggtttctctttatgctgatgatgtggttctttttattaatcccgtggcagaggacatgactatggtttcagacatccttcagctttttggtgaggcttctggtttatataataataatcaaaaatctagtgtctaccccatcagatgccatgaagacaatttagagattattcaacagttttggccctgtgagatatctagctttccttgcaagtaccttgggctgcccctgtcgttacataaattaagaagggagcaggtgcagcccattgtggataaaatagctaatcaactacctggatggaaagctgatttgttgactaaagcaggaagaagtgtattggtgcaatctgttttgacaggggtgctgatttatagtgttatggttgtagacttgccttctactactttgaaggacattgataaaattcgaagagggttcctttggcgtggtcgtaaaaatgccatgggtggccattgtgaagtggcctgggggctggggcagtgtgtgcagacctcgagagcttggtagattgggtattttcagcatcattgaactgagttgggcccttaaaatgcgttgggcttggctgcaaaaaactgagtcaggtcggcccttggcatccctgcctttgcataccccgaaaaaaattcgagagtttctacaagtagccttgtattctgagattggaaatggaacttctacccttttctggagtgatcgatggttgggtgggcagcggattggggatatcgctccccgacttattgagaccattcctaagaagctgattaacaaaaggacagttcaggaggcgatcgaggataatggctggattaatgatattcctgggagtttatctgttggtgcacttgcagacttcctgcgtatttgggatttggtggcacatgttgatctggacccccataaggaggacaaacatatttttcggttggctgctaatggcaaatattcgactaaagccgcttatgaggggctcttcattggatctgtggagtttgaaccttttgagcggatttggaaaacttgggctccgcccaaatgtcgattcttcttgtggctggtggctcacaagaaatgttggacaacagatagacttgagaagcgggggctggatcatccggaaaaaatgtcctttatgtgagtaggagagggagacaattgaccatctgcttgtgaattgcgttttctcaagagaatgttggttcctccttctaaggcaattcgggctgcagggtttggccccccaaccaacggatattaattttatggagtggtggcatcaagcaaatgaagctattcaggggtccttcagaggtggcctaaactccctcattatgctgggcgcttggattttgtggaatcaccggaacagatgcatctttgatggtctttcccctaatgttgctaatttcctaatccatgtgggggatgagcgccgtctgtgggagactgccggggccaaggggttgacatcccttgttgcctccctctctcatgtagcctagagttttatagatgagtcagtctatgctagtttcgttcaggccaccgtaaggcgtcagttgtaccccggtctattttagaccttgtttatttcttcttttaatataatgatacgcagctctcctgcgtgttcgagaaaaaaacaatgcagcgatagagagcaaactatctctctggaaagtttgggaattccttgtcatgatctgtcagccttagatgcaccattcactgaggaggtatgggacacaattttacaccttccttcggacaaggctcctgggccggatgggttcacagtcaaattctatagagtctgctgggagattattaaggctgatgttatggctgttttctcggcggttgggagcagaaggttcgctaattttcagatccttaacactgcttatatcacccttatcccaaagtttgagggggccgatcaagttaaaaatttcagacctatcagtttagttcatagtgttgcaaaattgctcactaaactcctcgctaatcggttggctggaagacttcatgatatggtttctcctaaccaaagtgcttttattaaaggccgcttcattcaggataattttatgttggtgcagcaaaccacccgctatctccatcaacaaaagcaacctaggatgcttctaaagcttgatatctcaaaggcctttgattcagtctcatggcccttcctcctggaagtcttgcaacatttgggctttggccaggtctggagagacattattagtggattgctatggacctcctcatcttaggtgatacttaatgggttacctggacaacctattcttcatcgtcgcggtctccgacagggggatcctctgtctccttttctgttcatcttggtcatggacactctgggcttcctgattaataaggccgcacaggatggactgctgcagccccttgctcctcgggcattgcaacaccgggtttttctctatgcggatgatgtggtgatctttcttcggccggcagccttggatatcaatgttattctggattgtcttcagctgtttggagatgcttcgggtttacgtacgaatgttcagaaaagcagcgtgtaccctattagatgtggagatcaggaccttgctttgctgcaaaatatgttgccttgtgagttagctgaattcccttgccgctatctaggtttaccgcttgccattaaaaagctttcaaaactccaagtacaacccatcattgataagattgcaaatcaactatctggatggaaggctgagttattgactaaagctggtcgtaaggtgcacgtccagcatgtcctcacagggatggtgatctacttggccatggctgttgaccttccagcttgggcccttaaagccattgataaaattcgtcgaggttttctgtggcgaggccgaaaagatgtaaaaggtggtcactgtcatgtggcttggggaattgtttgcaggcctcgcgaattgggtggtctaggcatttctagcatgaaagaacttgcatggtctcttagaatgcgatggctttggctggctaaaactgagccatctcgcccgtgggcctctcttgctatccaggtccctaaaaaggtcaaagatttcttctccatggctatgcaaactgagcttggtaatggggcaacaacctttttctggactgataggtggttatcgggtcacagaattgtagagttagtccctcgattatttgggatcattcctaagagacgggttagcaagagaacagtggtggatgctatctctaatcagagctggatttctgacattcaaggagctctttctgttggaattatcaatgaatttctcattttgtgggatttaattgactcaattgttttaagacctcaagttgaagaaacatttcttccgtctagctgcaaacagaaagttctcctcaagggaagcatataggggtttctttttgggatcttctgagtttgaaccttttcatagaatatggaaaacttgggctcctccaaaaaccaagtttttcatgtggttggtcgcacgcaggaaggtttggacagcagacaggctgcagaaaagaggtatggaccatccagagagatgtccactatgtgaccaggatcaagaaaccttggaccatatgttgatcggatgtgtctttgctcgagaattctggtttaaattgcttcttcaagtgaacctgccgtttcttgccatctgaggatagtgcttttcttgaatggtggagaacgttatgtaccaaagtctctggaattgcaagggacggcctcaattctctagtcattctgggagtttggaccttatggaagcaacgcaatggctgtgtttttgacaataagagccccagtattgctgatgctattagaagagttgagttggaggttcacctatgggagatggccggtgcaaagaaattatctttgctcaccgcccccatttcgggcatccctgctagttagctagcattgtggtaacttgtgttagtttcttatttagtcatggatgggtttctgtatgcctgttactggccgccataggcgcctcagttgttttttctgtaactgtccttcttctttaatataatatcgcgcagttctcctgcgctttcgagaaaaaaaaggtgatctcttgactgatatagttttctaaattcaatctaaccagcaattacgctgatgtatttggttgtggctgatgaaaataaaccaccatcttaaatatacttgtaggatattcagttattgaatttaatgctgacagttaccgtattttgcagccacatgaaccagaacaaaatgagagcatctatgatttcctatgcagctctaaagttcggaattttgaaaagaatcatttggatacccgtagacaaagtactgaaaatgcttcgatatgtagattagcatgcaagtcttctaaaggcagtacgaccgtcaatggtgttgctataactatcgaccaggactttcttcatgctaaagtcagtatatgggataacattatcgatatgcgtacttccttacaaaacatgctaagagagtaagaagacatcctcctccatggagctattttactggtttattttggcatgacttatgcataaggatttgcttttttaaaaatatatatattgattatcctttattgaatttcttttaattgtatgatgaaggtacccgttaaatggatatgtggcggagccagataaatcacagttaatcgaggccctgaaatttcattccagaggtgctgaaaagatcggtgtgggagtaagagaaattaagggtgatgattatcgattgatacctgttctttttctctatcaaacacactggatcttttattaagaaagaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggacggcctcaatctttagatcaatttggaagtttggacctgatggaagcaacgcaatggctgtgttttgacaataaaagccccagtattgctgatgctattagaagagttgagttggaggttcacctatgggagatggcccggtgcaaagaaattatctttgctcaccgcccccatttcgggcatccctgctagttagctagcattgtggtaacttgtgttagtttcttatttagtcatggatgggtttctgtatgcctgttactggccgccataggcgcctcagttgttttttctgtaactgtccttcttctttaatataatatcgcgcagttctcctgcgctttcgagaaaaaaaaggtgatctcttgactgatatagttttctaaattcaatctaaccagcaattacgctgctgtatttggttgtggctgatgaaaataaaccaccatcttaaatatacttgtaggatattcagttattgaatttaatgctgacagttaccgtattttgcagccacatgaaccagaacaaaatgagagcatctatgatttcctatgcagctctaaagttcggaattttgaaaagaatcatttggatacccgtagacaaagtactgaaaatgcttcgatatgtagattagcatgcaagtcttctaaaggcagtacgaccgtcaatggtgttgctataactatcgaccaggactttcttcatgctaaagtcagtatatgggataacattatcgatatgcgtacttccttacaaaacatgctaagagagtaagaagacatcctcctccatggagctattttactggtttattttggcatgacttatgcataaggatttgcttttttaaaaatatatatattgattatcctttattgaatttcttttaattgtatgatgaaggtacccgttaaatggatatgtggcggagccagataaatcacagttaatcgaggccctgaaatttcattccagaggtgctgaaaagatcggtgtgggagtaagagaaattaaggtgatgattatcgattgatacctgttcttttttctctatcaaacacactgatcattttattaagaagaaaaaaaaggttgagaaacctatacggcagcaaacccactcacaccaaatagaataagcggatatgttaattttgatcattgtgaaatcatgagctgcatgagaagatatcctattttgattacgttcttgtgtatatgtgcttgtcatttggtcaagcctattgtccatacattagtgttagaaaaatgccactgacatgctgttgaatctactggaaacacattacgtgcattaaatttgacctttatacaatatcgtcgtcagccttgcaagcattgtaaaagcttctcgtggttgagcaaacaataatctttcctcaccgagcagatggccctttgtcaaattacaccttgatatatatccctgtttattgcaaaattgcatgctgtaaacgtgacgtgaaaagtattaggcagtggtcgtgccttttttttttctgaagtcgtgaccattcttttaacatcccgtcttacgtgcagatcgggttgaatcctagtcacccaggtacaaggtgcttcattttgctgagaaacgatgataccactgaagacttttcttaccacaagtgtgttcagggtgctgcagactctatctcaccccagctcggaagttatttgaagaaactatattacagagcataagcttatgcaacactcccactagttcatttttttaactaaaacgtggcaaataaaaaagaacggatggagtaggattttggaaagtgttcctggcaacatcttgttctgatcagaccatattaccaatttctgataaggaaactacgtgtcgcattttaaggatgaggtgaaaactgaaagggtctggcgctcagaactcagaaggtcttctggactggaggtgtatgtcaactcaactcaatgggactatgtaaggtgggcctgagtcatgactgcggtttcatgcctgcaattctctagtcagtagtataaatactagtctgcgtgttttctaatatgaagatccatctattttattacttaaccatagcgtagatgattggtaacagatagatacattttatttactgattaaaatgcagcagcgactccccgaacttaaaacaggtaaacgggtgtggaaacttagtggctcattcaaaactgtctaaaatcgggtttgctcaaacaaagtgtcgacatggcatgtcatgttgaaatcatttgagtctctaaatttggtttacagacttttattagtgtgcttcaatcgtagcacaccaaatcagtattcggtttgagcatccgatttctgatggttttgcacaggccggccaagttatatgatctagttttttaacttaggggatctaattgatacaacatgccaagtttaagaatggctattgtatcttactcttatttattgaacaagtaatgcacattcccagtc

SEQ ID NO: 688 - DNA, 10166 bp, Zea mays
atcgaccgggcacgctcatccccgctggcgaggataaccgggatggagacgagggccacccagcggcgctgcggcggctccgcctccgcctccgactccgcctcctgacgggcacgcgacgacgactccgccgccgacatgtctggcgcgagcagcgtgaggcgatgcggctgcactgactgcagtacttgggagatgggggatgggagggtggcgagggcgcgaggcggttggttttgggggttggatttgaattgatccgtgtgccgtgcggtgcgtgcctgctacaggacagggaaggggattttataggcaggggcatgagaagggcttgaggtagcgatggcagcgtcggcgtcgacgactgggcagccgatgggtcgggccggcgtgctgtctgctcgactgctccgctgcttggcgcttgcacagcagcacggtcctcgtcctccatgaagccgagcttcttcatgagcacttggcgagccgtcggccgtcgcctgaacatcggccagcggccaaggcgccgctgcaatgaggcgtgccttttcccacgccttgccgccatcgccccccgccccgctgcgatggtccttggagcagcggcctgcgtggccgtgttgatgagagtggccggtgtcgtggtagtcgtcgtgcgttgcctgcgtgggttgcgcgcgcctgacgtagaagacgcacttggggcggatcgaaccttagttctgttccggccgggtacccaagaggacgcgccctggctggagcgtggcgactgcctgacattgttagcttttttcccttttaaaaataacaaggatcagataatcaatcgtaatttttgtaccacggccatcacaccgcaaattgcagaacacttcaacatgttgaaacacttttttgcagtgtaatgcggaggaaagctgaacaaagctactcacatttttgactggaaaatgggtgcaagcacaagtgcatgactctacctgcatgcagtgcagggctcatgcatcatgggtctctgttggttggactagcaaacacgacccgaatatataagcaggagacctcttctgactgaaacccttctgttgttggttgggtagcgatcatcttgctcccgctagctgccttcccccattcccagctcctactcaactccactcaacaacctagaagccgcatcatctgcttcttcttcgatcttctgcctggttgcctacgtctgcatcgtcgtgttcgctgcttcacctgaattcacaccccgtcctgtctgctgattcttggacagacaagacgccattgaaatggagggcgacgatccgacagctgctggcccgaccgtcccagaggcctccatccgccgggtcaagctcagcgtcgcaagcaactaggagatcgtaagcaccgtcctcctcctcgtcgtcgtccatccccttcatgttgtcttcttccatcaactctcgctgtctgttagctcatgctcatgcatcttcttctccgatggacaacacccatcatctctggcccgcagaagctcatggcgcagctggtggagaatcccatcctgatcacgcactgcagccagctccacgacaacccatccctgggcctgcccctgcaggtcggcggcagctgcgagtcctactgctgcagcgccacgcagctcgacaattgcgaagggcatttcggcttcatcaagctgccggtgcccatctaccaccccagtcacatcaccgagctgggaagatactcaacctcgtctgcctccgcctcaagaaacccaaggtacaagaaccctgtctgccacatttcagagaaacatatccgttacagttgttgcaaacataatgactcatcacatgcttccttgtcttttttgtctattattctcaagcagaaggacaccgggaaagaatgcagattcacctcatgttcatattgccaggtaagccatagcaaacttattgttcatacaaatttgctcacttagtcacccacttgagctacattattggttggaaatttctcatgttcagcacattcctgatgtgaaaaaagtacaatctggatccctactttgcttgaacaatgaaatagtgctgctcttacaaaccccagcattcctcttgttccaggacctcccaccgctatgcgtcagtcaagtgaagaaattcaacggtgcccgtagcttggaactgaaagcaccattaaagcaagaggttgccgtcaggttttggagcttccttgatcaatttggcttccacacaagtggtacatctcaccgccgccccttacatccaaaagaggtattcggggcaatatctacactcctgaaacctttccaatgtactcatagcttcttcagagggactcacagcttgttcttcaatttcgtaggttcaggacataatgaagaagataactgaagaaacaagagctaggcttgctgctatgggtaccatcttcaggatggatatgtgatggataacatgtccgtcccacccaattgcctgcacgtttcaaatattttagatgacaacacagaaatgtgccctcccgtaagtacctcctgataaaacaatgagattacctgtttgcataagacaccctgtcaagggcgtcgagcccctgggtggccggaccgcggctacgcagttcgtagccgtcggccgtcttctccggtgaggttattcccctcaaccgtaggcttaacagagagggagagatttgggatataattcctgcttgctttattaaaagaaccgcctgctttatatatagccaggccagccaaaccaactcctatttcttctctatacttatcttcctaaacaacttcttaacaacttatccctatttgctagcagcggccagctctgatctgttgctggccgtgagcttatcttctaaacaaccctccaattttctagctactagcaactgcagctattcctgcgccctgatctgctgctggccgatatcttatccaatggaacctgcggctgttgcctcttgggcgtgttcagcgcgctcacgcgcacgccgtatgtcacgggtacgccgttgcctgacgtaggggcggccgtacatgacatctctcccctcctcgaagaccagctcgtcctcgagctggaacgctggatgccgggtgcggaagtcgtcgacgtcctcccaagtcgcagactcggccggcgcgccgtgccactgaacaagcacctggcggacaccgcgtgccaggcgagcccgcaccacccgggctggttccggcaccaccgcaccatcgatggtcggaggcagggcgggtggcgacgatggtggcgctcccacaaacttttttagcacgccaatgtggaacacatcatgaagacgagcgccggcgggaagctccaagcgtacagccacgtcgttgatcaactccgtgacgcggtacggcccgacgtaacggggcttgagcttccctgctaccgtgcgcggcagtgaggcagctgcgcgctggcgtagccgtagaagagcccagtcgccaacctggtaggttaccagccggtgcgacttgtcgtagtggtgcttctgtgcggactgcgcctgctggaggcggtagcatacgtccgcgaggaaggcctcccttgcctccatctcttgagctaccgcctcgacccttgtctcgcccggttcgtaagaacggattgagggtgggtcacggccgtagaccacccggaatggcgtgtcacggagggaagtctggtacgcggtgttgtagatgtactcagcccatggcagccagcgcagccattgccggggacgatctcccgtgaagcagcgcaggtacatcacaatgacgcgatttgccgcctccgtctggccgtcggactgtgggtggaatgccgaggacatgagtagctttgttcccatgagcctcatgagctcactccagaaagaggacgtgaacaccgggtctcggtcggagacaatggactgcggtaccccgtgcagcctgacgatgtcggtgaagaatgcctgtgccacggactcagcggtgtacgggtgcgccagtggaatgaagtggcaatacttgctgaagcgatcgacgacggacaggatcaccgtcttgccgtgcacgcggggcagcgcctccacgaagtcgaggccaatgtccgcccagacgacggaggggatcggaagggggtgcagcaggccggcgggatgaaggtgctccgacttgtactgctggcaagttgcgcacgcccgcacaaagtcctgcaccatgcgcctcatgttggggaagtgaaagtcgcggcgcagccggtggagtgtgcggtgaacgccctcgtggccgtctgcgtggacagcggtaacgatctccggcagtagaggggaggcggcggggatgtagaggcgcccgtcgaatgtgaccatgccgtccgtcacggcccacggggcagcgcgtgtgccggcgcgtacctcatcgtggacagccaccaaggcgggatccatggcctgggcatggcgcaagcggctgatgaagtcgaaacggggcgctgagatagccaacagctcaccttcctcggtgtttcggcgagagagcgcgtccgccacgacgttagtcgcacccgacctgtactcaacagagaagtcaaagcccaacagcttcccgacccaatgatgttgtgggatcgtggccaggcgctggtcgagcaagtatttcaagctatagtgatcggtcttgacaacgaactgccgaccccagagatacggccgccagtgccgcaccgcctggacgaggccgatgagctcacgctcgtaggccgcgagagcgcgatgccggggggcgatgggtctgctaaagaatgccactggatggccctcctgtaccagcacggcgccgaacccatgtgacgatgcgtcacactcgacgatgaatatcttcgcgaagtccggcatggccagcaccggagcagatgtgactgcggccttgagggccgcgaatgccgcagccgccccgtcatcccaggcgaagccatccttcttgaggagcgcggtcagcggggccgccaccggcccgtagttgtgcacgaatttgcggtagtagcccgccaatccgaggaagccacgcaccgcgcgtaccgaacgtggagctggccagtcgacgatggcctgcaccttggctgggtccatggccacacccgccgccgagattacgtggcccaggtaggcgacggacggggcagcgaacgcacactttgtacgcttgacgaagaggtggtggcggtgcagctcgtcgagcacggcgcggaggtgtcgaagatggtctgcccatgtcttgctgtatatgagaatatcgtcaaaaaagacaaggacgaaccggcggagaaacgggcggagcacgtcgttcatgagcgcctggaacgttgctggcgcgttgcagaggccgaacgccatcaccaggaactcgtacagcccatcgtgagtgcggaacgccgtcttgtgaatatcttccggacgcatgcgcacttggtggtaccccgaacgcaggtccagcttggagaagtaccgtgccccatggagctcgtccagcagctcgtcgaccacgggaatgggaaaggcgtccttcaccctgagcgcgttgagggcgcggtaatcaacgcaaaagcgccaggacccgtcgggcttcttgacgaggaggaccggcgacgagaagggcgagtcgctgcggcgtacgatcccttgctccatcatggcggcgcactggcgttccagctcgtctttgtgggcagccgggtaccggtatggccggactgccacaggctgcgcgcccggcgtcagggtgatgcggtggtcgtgggcgcgctgcggtggcagaccggtcggctcggcgaagacggaactgaaggagtccaggagtgcgtcgaggaactgctcgctcgccaccgtggcgctgattgctgtgggactggcagccgagacgccggtccagcatatcgggcgcccctggaattggaacttcatgcgccggctgcccaggtcccacacaataggacccagcgcgcccagccaccgtgtgccgaggacgacatcgtacccagcgagcggcatgacgtagagatcggccgggaacggggtaccgtcgatggtgaggggggcgtcacggaggaccccggcgcaggtcacgcgctcgccgttggcgaccatggcggtgagacgtggccgctggtgaaggggcagacccgtgcgccgcgccgccgcctcggatatgaagttgtgggtgctgccggaatcgaggagggcgaccagcgaggcagcaccaagcgcgacggcgatctgcatggtgtcagccacaggcaccccggccagggcctgcagggagaaacagggggcctcaccgtcagcgtccggaggctcgtcgttagtgtcttcaatctccacgccctccatgaaaaaaatacgtctgcaaaaccggttgtggccacgcgtgtacttttcattgcagttaaaacagaggcccatgcggcgccgctccgccatctcgtcgggggtgaggcgccgttgattgtcctcgccacggccctgctgggtggccctcggtggtgcagggagcgccagcggctgctggggcgctggaagcgctggacgtggcgccggtgcggacagcagaccgcgcgggggcgcccgaggtgcaggctgcaccagccggtcggcctccatcaactccacttggcgcgccaggctcatggctgatgcgagcgactccgggttgtggatgcgaacgacatggctgagtggtggcagcaggccgccggtgaagagctggacgcgctggtgttcgtcgagacgaccggcgcgagggagaagggcctggaatctatttgcatactcttccacggtccctgtgcgcctgcattctgcgagctcgaacagcggggccgatcggaggggaggtccaaaccgtaagttgaggaggtccctgaaccgtccccaggttggcgtgccctcgtcctcctggagttggatgtaccacagctgcgcgacgtcctccaggttgtatgaggccatccaaacgcgctcctcccccatggtgcgctgctggcggaaatacgactcacacttgttgaggaagagcataggatcggacttgccgtcgtagcgtgggaagtccagcttctgaaatttaggtgggcgatccagatcgcgcggcatctctgcgtgtcccccggcgccgtaatccgacgttgacgccgacttttccttcatggcggccatgtcagcctccatggtggacatcttggtggtgatggccctaagcatctccatcacgtcctgcatggacggctcggccatggtggctggttgcagggccgagttggtggaagattggggtgaaggtggagggctggtgtgggttgcagcggttgtggatgaaggattggagcgagtgggagaggatcgccgggatcgcgataccaagttgtcaagggcgtcgagcccctgggtggccggaccgcggctacgcagttcgtagccgtcggccgtcttctccggtgagattattcccctcaaccgtaggcttaacagagagggagagatttgggatataattcctgcttgctttattaaaagaaccgcctgctttatatatagccaggccagccaaaccaactcctatttcttctctatacttatcttcctaaacaacttcttaacaacttatccctatttgctagcagcggccagctctgatctgttgctggccgtgagcttatcttctaaacaaccctccaattttctagctactagcaactgcagctattcctgcgccctgatatgctgctggccgatatcttatccaatggaacctgcggctgttgcctcttgggcgtgttcagcgcgctcacgcgcacgccgtatgtcacgggtacgccgttgcctgacgtaggggcggccgtacatgacacaccctcactccagataattatagtttctcctgattgtctcttcctgatttaggatacaccaaaaggcttgttgaggaaaattctacgcacgatagaacaaatcaaaagcttaaatatcagccaaacacgtgagttaggggcagatgatcttcaggtagctgtaggagattacatggatatgggaggaccagcagaggtacccatccttaatctgtaaaacaagtagaaaccatgttattgatcataactgcagcaacataatgtgttacgtcttatgtctttcgaaggttttccagcatgtcacctttacaagacagcctgcaccaaaacagtggcataaaaagatgaaggccctcttccttagtaagagttcaagctactcatgccgtgcagtgatcactggtgatccatacattggccttgatgtagtaggggtgcctgatgaagtagctagaagaatgacagtacaagaatgtgtcacaaactacaacattgctcggctgcaagacatgatggagaaaggactatgcctaacatacactgatctcaataccaacacatatgacttggatggaaagaaaggaaacaagaagtgcatcatgccgagggttggtgaaactgtagagcgaagagtccttgacggggatctcgtcttcctgaatagaccaccaagcactgacatgcactcagttcaagccttatatgtccatgtccatgatgaccacaccataaagatcaaccctctcatctgtggcccacttggagcagattttgatggcgattgtgttcacatcttttccccaagatcagttccaggaagggttgaagctgcagagctcttcactgtggagaaacaactgttaaactcccacaatgcgaagctgaactttcagatcaagaatgattacctactagctctgaagataatgtgtgtcaggtcgtattctagagaaaaggcaagccaaattgccatgttctcgtcagggatgattctaccgggtgattggactattcctcagattctacagactaccgatgcattaagaaccctaccaagccacccaaacaaacaatctgttggagcctcagttactgccatcatctcatcaactctttcagaaaaaggtccaaggggggccataaagctcataaatcttctgcagcccctcctaatggaatcactgcttatggatggtttcagcataagcttgaaaggtcttgatggccggtgtgcaatgcagaaggcaaatcaaagtagttcgcttgagaccgataagttcaacaagttaactgtggactccattgttaattcctctgcccttggtctgctggttgacccaaaaaaagattcaactctgaagaaattagttgaacagattggtttcttgggacaacaactgcaaaggactggtaggttatactctagcaacttagtggaggactgctacaactttctggaaaggtgcagcggaagcaccaaatgttatgatccttcaaaaggacatgattttgttacgagttcattttacaatggtttaaatccatatgaggaattactccactcaatatcagtaagggaaaagatagagcgctcatcatctaaaggactggctgaatctggcaatctttttaagaacatgatggcaatgctccgagatgtcacagtatgctatgacggaaccatgagaacttcgtgcagcaactcaattgtacaatttgactcgacaaatgtatcaagttctgtgacaccaggtgatccagttggtatcttggcagccactgcatttgtaaatgctgcatacaaggcagtgttagatccagtttttggacattccgtcgagcacccgccgggcgcacaaaatcctcgcatgattgcctcgcgtaggcaaggtcgtgagccacacagtcgaaatagcggagcagcaaggcaacatcggcgaagcacgtgcactgcactgagttgtgccatcggcagacatgaatgtggcatccttgggcgcgctccagttgcgcttggggagcgcggcgccgcctagctcggcgatggccgccttcagctccggaaactccggccggagcgggtggccggcatcggggtcgaagacgtcttcgtcgctggagccgaagaagaagtcggagttgaccggaggtcatcgcggggaggaggaacgggagcagctcctcgtcagggaaaatttccctgcagccgaatatgtatag

SEQ ID NO: 689 - DNA, 3165 bp, Zea mays
ccaactttgtgctcttattgcagggtacacaccagcattcttcttttttgttctggcttgaagtaagagtaaatagataccttggactagttactggtatatgtagggatatggaagtaaatgcccacgctaaaataaagtatatcagtgtttcaaattgaaccactttcctctgtggtctgaatgattgacgagttgttatttaagaggctgaagacataacaggatatactgattcagtgccttagggaggtactatttcacactgaaatttattcaaatgcagctaatctggttatatatccttcataagtaacttcagtatagttgacaaatatagcatacacattgaagtcagtcatatgtccttgttgattagtggatggctttcatacagtaatcttgcttgctgctggtctggtgccagtgcttacactaaacctgtgttggctggatgagtgtccactaatgtttcctgaccatcccagaacttgttgtttataggatattccagccctgtctttgaaggaaatcaagacaacagatggtgcaattcgtttagagttgagagcacctcataataaacacatgacagaacgttcatggaactttcttgataaatatggatttcatcatggtggatgttctcaccataggacactgcttccagaagaggtgatattcttatgagtcatgagttatgctttcacgagatttattttggtagcttttatgaattccaggttgtttgaataacgcactgataattgatttatttcttgattatttgttaggctctaaatatattgaagaaggttcctgatgatactaggagaaagctagctgcacggggatacattgttcagactgggtatgtgatgaagtaccttccagtacctccgaactgtctatatattccagagttcaccgatgggcagagcattatgtcatatgtgagttttctagtacatgtatctggtagtttcttctatttgttgagtcctatctgatgtcctgatttaattgcttttcataccaggacatttcaatagctctgttgaagaaggttcttcagaaaatagaacagattaaaagatcaagatctggttccccaaactttgaatcacatgatgctgaatcatgtgatttgcagcttgcgattggccagtacatacgtctaaggggcactacaagggtatgtgaaaaaattagataatttaacctgtttacatggtgcatgagaaacagtcacagtttatttataaccactagaattacagaaatccctgcacctttgtgtgctttgatcggttttatagtgcacactggcatttatttctgatcatcctttttatttctagctgagttgtttttttgtattctctacgaccacgataacttttgtatcttattttgtagggccctcaagacaacaccaagcggtttactgttggcagtgctgattcagctgcattgtcaacaaaacagtggttagaaaagatgcggacactgtttatcagcaaagggtcaggtttttcatctcgcagcgttctgacaggagatccatatattgggctaggtgttgtagggcttccttctgaagttgcaaagagaatgacattcgaagagcaggtaactgacataaacattaacagattgcaagacgtggtagacaagggactctgtttgacctacagagatggtcaagctacatatgccatcactgttggatcaaaagggtacacaacacttaaagttggtcagactatcagtcggaggatagttgatggggatgttgtgtttcttaacaggccacccagcacacataagcattctctccaagctttctacgcatatgtgcatgatgaccatacagtcaaaatcaatcctctcatgtgtggccccttttctgctgactttgacggggattgcgtacacatatattatccacaatcgcttgctgcaaaagctgaagccttggagctttttagtgttgagaggcaactcattagttcgcacagtgggaaggttaatctccagctaggtaacgactccttggtagctatgaaggctatgtctcatacaaccatgttacacaaggaattagcaaaccagttggcaatgtttgtgccattttcacttcttgctcctgctgtaatcaagccagttccatcttggacaatatcacagatagtgcaaggtgcatttccagctaacctgacttgccaaggggacacacacttggttagggacagcacaatcataaggctggaccttggcaaagaatctgttcaggactcattccctgatttggtgtcctccatccttcgtgagaagggtccaaaagaagctctgcaatttctgaatgtgttggagccattgttgatggagtttttacttcttgacggtttgagtataagtctgcgggattttaatgttcccaaggctttattggaggaagcacaaaaggacattcgaaatcagtcccttattcttgagcagtctaggtgctctacaagtcaattcgtagaattccgagtcgaaaacaatttgaaaaatgtcaaacagcagatttcagattctgttgggaaattctctgaccttggtctgctgattgatccgaaaaaggaagcctcaatgtcaaaagtagttcaacaagttggttttgttggcttgcaactgtatcgtgaaggcaagttgtattcaagacgcttggtagaggactgcttcacaaactttgttaataaacacttggccattggagatgagtatcctccagaagcgtatggtcttgtccaaagttcatattttcatggtctcaatccttatgaagagttgatacatgctatatccactagagaagctatgatccgctcctctagaggtctgtcagaacctggaactttgttcaagaatttaatggccatcttgagggatgtagttatatgttatgatggaactgtgagaaacatttgtagcaattctatcattcaacttaagtatggggaagatgatgaaactgattcttcaagtgttgtacctcctggtgaacctgtgggtgtcttagccgccacagctatctcgaaccctgcatacaaggctgtcttggattcctcccaaagtaacaatgcttcatgggagtcaatgaaggtagtaatgttataa

SEQ ID NO: 690 - DNA, 10345 bp, Zea mays
cacccgggtgggttacgtggatagaggggtctgccgcgataggggtgcggccttagttggtcaagccacatgtgttgttatggccctgggcccatcttacgctgacacaaccttgcacgggatgaaagttggtcgaggtcttcgcgccttggagttcgtcgacgtagttcttgctagagtcgggtgggacgaacccaccctcgcaattgacgccatcagagaagatcttctctcggatggatccgcgatgcggtgcaagaccccttcttgatccgtaatgcaggagagggatctaaagcagaacacctcaccgacattgaaggtgaccggggtattgaagatgatagccatgcttttgaccaggacaacgtcgttgactgtgactcgatggtacgcgcaagagcacgtcgaatcacacgaaggtttatataggttcaggccgctagaatgcgtaacaccctattttttgtcgaggctatgtattggagtttcactggtgtatacagattataggcgaactgtgggtggtggaggatgagttctcctgctggtctaatggtgcgtggttgctatgaaaatgttaatgagctacgggatagtgttgggatgtgatgagataagatgctttcgtaggggtacccctcggccttatatagatgactagagagttattcttttacaggttgtcactatctaactctacccgaattcctttacgggttgtcaatatctaactctactggaatcctcttttaacgcaagatgcattcatgcttattcgaagttcggtcactttttcagtcgagttaacgccgagtgtttagctcttcagatgtgtgcaacctcttcgcgcgagacatcaacgttccggtctgcgcataacccagacatccggtctctatttccttgggtcaagctcgtccgatctaggcctggttgtgattcgagggtttgtcttgctagacatgccattgggagctcatgaagcgtttatgtgttcataagaacacagagaatatttatctcctacacaaccaaacacccccttaatatcactcaattcacatagagaaaggcgggatgaactgagcctacaacggctgtatgggcttatttacaccgcatattgaagcccaactcacgatgtttatttccacagagcagacccacaacagtacaacgggcactcatcaggcagcatatgtccgagtccgatacagtcaaccaatcgaacttgcctccgtgttgacccagcacactaggcggtacaccgctctcccacaccgtacgtccctcatccaacgttccacactcgctccataagcggttccgcatcgccgcacccagtccacatagggcaaccaaccttccccaccgactttacctgtaccaccatacaccggtctcacgcgcccacgctgtcttagccatccagcgcaggatagcacccgcggcgcacgctacgtctataaatagacccccaccccctctccatcgagttctttccccagaggcaccctcaatcccctttcccctcctccctccagactctcggaggcgggcgcgcggatctgtcggccggggccgatccagtcgattccaccggacaaggccgccaaaaacacactcgctcgacgcagcgagcggggccggcccttcgtgccgcggggcgcccggtggcgagggccgcagcgcgcagcgatctgaaaccctaggtggtggtgggcgccgccgccgtgtgtagacgcgatggatgcgaggttcccgtactcgccggccgaggtggccaaggtcgagttcgtgcagttcggcatcctcagccccgacgagatcgtaatacccctcgcctccctcccctcccctcgctgctactgtcattcgagcgggtcgagggttgagttgagtgagtggtcagccttagtgtagctggactagctgtttgctagtctaccagtaccaccccatttccagtgccaggagcccaggatcctagttcaggacatgttttggtgcaattcgtgcctgatttgagcttcattgccctatttcctgatttggtctagttgaaatcgagcaattctgaatctgtagtataagcgcacaaccgtacagaccttcatccctacaatctgagcttcatcatcaggggaaaaaaaccgaaatgtataggttttgcttcttgatgcctggaactatgcatataaactgctggaacagtattgtgcagagatgaaatgtatggttgagtttggaaccttagcagttctgctttgttcttgggtttcaagtaatatgatgaattaattcatgtactgttgtgaattgtgatcgacacagctcatgatagaccttgaattttgttgttgtttgccttattttttgggcacatgcatgttcttaagtgacgcgatctgtttcgtatagtattgttctgatctggctgagttcaacttcggctgaaacagctgtgtgttccatatgaacacagcagaaattccatggtagttagcaacaagatgacgttactaccgagtttctttaactgtataatttattctgccgaatagaaacgcttcattaaaacattattctggtttgtttgcacgtggcgtgcgaggaacaggtttctggggatagaaactaatgactgtttctttcttcctgcttttgtagagacaaatgtcggtgattcaaatagaacacgcagagaccatggagaggggcaaaccgaagcctggtgggctcagtgaccctcgattggggactatcgaccggaaaattaagtgcgagacatgcatggcagggatggcagagtgtccaggccactttgggcaccttgagcttgccaagccgatgttccacatcggattcattaagactgtgctctccatcatgcgttgtgtttgctttaactgctccaagatcctcgcggatgaggtacctatggctcagttattgattgatgtgtatatatcttgctatactggacggagttatcattttaaatagaggcatggtaaactgaaaatggagggattctcaccattcaatacatatgaaaaatacagttgcccgattttactctacctggtggtgttcattgttagcgcattttctcactagccattaacctctggaggtatcattctggcatgtaaactgtgattattgtacttttcttctttatcatcctatgacctagtatatcttcatggtttgttctgacttgtttgatgaaccttataaggttatattttgtatccattgcactattcctatagtaatcagggcgtaaccaaacactaagttttgagtctttttcatgagttcatgttcaagtgtttacacatttgaccacttcattagatgcttacaatgtttagcatttgtgttgcaaaaccaaattatatttacttgttaatcaccatttatctatttttgtcttgcaggatgaaaccaaatttaagcaggctttaaaaatccggaatccaaagaatagattgaagaggatatatgatgcttgcaagagcaaaaaagtctgtgcaggtggcgatgaccttgatgttcaggaacaggatactgatgagcctattaagaaaagaggtggctgtggtgctcagcagccaaatattacagtcgatggcatgaagatggttgctgagtttaaagctccaaagaagaaaactgatgatcaggatcaactccctgagccagtggaacgcaagcaaatcctctcagctgagagggtatttctataatctctaatcaattcagcaagttatgttatttcttgtaattggtttcttacatggcttgtttgaccaggtccttaatgttcttaagcgtataagtgatgaggactgtcttctgttgggcctgaatcccaaatatgcccgtcctgattggatgatacttcaagttcttcctgttcctccaccccctgttagaccatctgtcatgatggacacctcttccagaagtgaggtaagcctaataccaatatacttcctatgtcccaaaataaatatctttctagaaattttcagacagataagaacggtggcaaaaaaaaaaacaattatccccatctccttccctttcccgtaggacatctcctgactttgctagctatcatttgcatgcacctgtgattagcgtttgtattaggagtcaatgtcccatattattgtagaatgctattttttttgggacataattaaaacctcagaaagttacttattttggcacggagggagtagttattatgtgtctaattgttgctgcatggatggcgaagtgcaccctcattactcactgatgatattctattaataaatatgtttaagggctactacttcagtccatgtggtaaagaaggtatttatttcacagcttttcactgtgattcttcttggcctttgcgctgtttctacaggatgatctgactcatcagttagctatgataatacgacataatgagaatttgaggaggcaagagagaaatggtgctccagctcacattataacagagtttgctcagctgttgcaatttcatattgcaacatacttcgataatgatcttcctggccaacccagggtgagtggtttagaatgtcaatttgcatgtataaaatcaatagataccaggacaatatttaaggatcctttttttttgttgaaatgctcaggccacacaacgttctggaaggcctattaaatcaatttgcagcaggctgaaagctaaagaaggcaggattagaggaaacttgatgggcaagcgtgttgatttctcggcccgtacagttatcacaccagatccgaacataaacattgatgaattgggagtaccatggagtattgctttgaacctgacatatcctgaaactgtcactccatataatattgagaggtgaaccagtttgttcttattgacaaatgttatttaattagtgtgcttttgctgatcatttgcagctaattccaatgatttcaggttgaaggaacttgttgaatatgggcctcaccctcctccaggaaagaccggtgcaaaatatattatcagggaagatggtcagaggcttgatcttcggtatgtgaagaaaagcagtgatcagcatctggagcttggttacaaggtaaatatcaactttcactatgattatagctgctgctgactatagaagttgctgcttttgtaaagtttatgttttgactcattttggattctcccaggtggagaggcatctcaatgatggggattttgttcttttcaatcggcaaccaagtcttcataaaatgtctatcatggggcatcgcatcaaaattatgccctactcaactttccggttgaacttgtctgtcacttcaccatacaatgctgacttcgacggtgatgagatgaatatgcatgtcccccagtcatttgagaccagagcagaagttctggagttaatgatggtgccaaaatgcattgtctctccacaatcaaataggcctgtaatgggtattgtccaagacacactgcttgggtgtcgcaaaattactaaaagggacactctaattgaaaaggttgataaagagaaattccacccgtcctttctgattatatgatgttcagttttgtgactcatttcaatttcattccaggatgtatttatgaacatcttgatgtggtggcaagatttcgatggaaagattcctgcacctaccattttgaaacctaggcctatttggactgggaaacaagtttttaacttaattatccccaagcaaataaatttaattcggttttcagcatggcattcggaagaagaaaaaggatttattactcccggtgatactatggtcaggatagagaagggagagcttctgtctggcacactttgcaaaaagagtcttggaacaggctccggaagtcttatccatgtcatttggtaatgatgcctcatctgaattttactttttgaaagttgcatgacaatgataaatattgccgtttccattttctaagcaaatcccgttttaatttgttcttttcagggaagaggttggtccagatgctgcccggaagttcttaggacacacacagtggcttgtaaactactggcttcttcaaaatggtttcagtattggaattggggatactattgcagatgcatccaccatggaaacaattaatgatacaatatctaaagctaagaatgctgtgaaggagcttattaaaaaagctcatgagaagcagttggaagctgagccaggacgcactatgatggaatcatttgaaaacagagtgaaccaggtactgattgctctgtttttctttgtttatatcattcggaggagtattcactattcagtgtttaggttgagttgttttaacttcaataggatccctttctgtgtaggttcttaacaaagcccgtgatgatgctggtagcagtgctcagaatagcttgtctgaaagcaacaatttgaaggctatggtcactgcaggttcaaaaggcagtttcattaacatttcacaaatgactgcttgtgtgggacagcagaatgttgagggcaagcggatcccttttggtttcattgatcggacgttgccacatttcacaaaagatgactatggtcctgaaagtcgtggatttgtggaaaattcttacctccgaggtctgacaccgcaagaatttttctttcacgctatgggtggtagggaaggtcttatagacactgctgtgaaaacctctgagactgggtatatccagaggagacttgtgaaagctatggaggacatcatggttaaatatgatggtactgtaagaaattctcttggagatgtcatccagttcttgtatggagaagatggcatggatgctgtttggattgaatctcaaaaattggactcattgaagatgaagaagcctgagttcgataatgtattccgttatgagctggatgatgagaattggagacctaactacatgctacctgaacatgttgacgatttgaagaccatacgtgaattcagaaatgtgttcgaggcagaggttcaaaagctagaagctgatcggtaccagcttgggtctgagatcaccacaactggtgacaattcgtggcctatgcctgtgaacctcaagcgactcatctggaatgctcagaagacattcaagattgattttagaagaccttctgacatgcacccgatggaaattgtggaagcgatagataaactgcaagaaagacttaaggttgtacctggtgatgatgctatgagcattgaggcccagaagaatgcaaccttgttctttaatatcctacttcgtagcacgtttgctagcaagagggtcttgaaggaatacaggcttacaaaggaagcttttgaatgggttattggtgagattgaatcgaggtttcttcagtctttggtggcccctggcgagatgattggatgtgtggctgcacaatctattggagaaccagcaactcagatgaccctgaataccttccattatgctggtgtcagtgccaagaatgtcacccttggagttcccaggttgagggagatcattaatgttgccaagaagataaagacaccatctttgtctgtttacctgaagcctcaggtgaaccagaagaaagaattggctaagaatgtccagtgtgctttggagtacactacactgcgtagtgttacccacgccacagagatatggtatgatcctgatcctctagggaccatcattgaagaggacacagagtttgttcagtcctattatgaaatgcctgatgaggacattgacccggataaaatttctccttggttgctgcgtattgagcttaaccgtgagatgatggttgataagaagttgagcatggctgatattgccgagaagattaaccgtgagtttgatgatgatttatcatgcattttcaatgatgataatgcggataagcttatcctccgtatccgcatcacaaatgatgaagctccaaaaggagaaatacaagatgagtctgctgaggatgatgtcttcctaaaaaagatagagggcaatatgttgacagagatggcgcttcgaggcattccagatatcaacaaagtgttcatcaaagaagggaaggtcaataccttctatcaagatgacggtttcaaagcagctaatgaatggatgcttgatacagaaggtgtgaatcttttagctgtcatgtgtcacgaggatgttgatgctacaaggacaacaagtaaccatctgattgaagtgattgaggtacttggaattgaggctgtccgtcgatctctcttggatgagcttcgggtggtgatatctttcgatgggtcatatgtgaactaccggcatctggccattctttgtgatacaatgacatacagaggtcacttgatggctattacaaggcatggtatcaaccgcaacgacactggacctcttatgagatgttcctttgaagagactgttgacatcttacttgatgctgctgtatatgctgaatctgaccacctgagaggtgttactgaaaacataatgcttggtcagcttgctcctattggtactggaggctgtgcactatatctgaatgaccagatgttgcagcaagcaattgaacttcaactcccaagctatgtcgaaggcctagactttggcatgactccagcacgatcacccatcactgggacaccttaccatgaaggaatgatgtcgccaagttatctgctgagtccaaacatcagggcttcgcctattaatacagatgcttcgttctcgccgtatgttgggcacatggcattctcaccattcccttcaccaggtggttactccccatcgtcagggggatacagcccatcttctccggttttcaccccagagaaaggatatagccctctctctccatcatatagccctgcatcaccaagctatagtcccacctcaccgtcttacactcctggctctcccacctacagtccaacaagcccgaattactccccaaccagcccgacgtactcgcctaccagcccatcgtactcacccacatctccgagctacagcccaacatcaccaagctacagccctacatcaccaagctacagccctacatctcctagctatagtcctacatcaccaagctacagccccacctcaccagtttatagcccaacctcaccagcatacagccccacatcacccgcttacagccccacatcgccatcctacagtccaacttcaccatcttatagccctacatcaccttcatacagccctacgtccccttcatacagccctacctccccctcatacagccctacctctccctcctacagcccgacatcacctgcttacagcccgacatcaccaggatacagcccaacgtcaccgagctacagccctacatctccgagctacagtcctacatctccgagctacaatccttcatcagccaagtacagcccttcacatgcatactctccaagcagccccaggatgagtccatacagccagacttctccaagctacaggtgcgcacaattctgtgttgtcaaagggtactctgtccatacatatctgtattgactgttactgtttctgtttgcgcagtccaacgtcaccgacttactctcctacatcaccatcatattcacaaccaagtccatcgtacagcccaacgaggtgagtgccatccagatcttcatatcttgtggtgcgtctccaattatcatgcctaccgccgtctgttttacacatttacccaatcaatgcagcccgttcaacacctctggaggacccagcccagactacagcccgacctctccaaattacaggcaagtcattctactgccagccaaatgtatacctgtcgtggaggacatggtttcgtgttctgacaaaccttattttgcacaacgcagccctagcggaagctactcccccactgcaccgggctactccccgtcgtccacaggccagggtaatgacaaggatgataagagcgctcgttgaagaggcacaggagaacaaggcgctctagagcactcgatgaaggcactcggtgatggccacatgggaagatcgaggcacttttttttcccttgagtttttgtatggttgatgaactctgagagcaaacttgtatttttccgagctgctaatagcagaaatagttgtttatgtatgatactagaactaaggactggactgtgctgcgacttgataagtggttaaccgcgtggtcgcccctcagagagtaacacatgtagtaatgtttaatgataatatcgtgactgtacttggtactactatgctatggtgtactagtgtattgcatgcgcgcgtggagcaga

SEQ ID NO: 691 - DNA, 12937 bp, Zea mays
cagtttataaaaaaatttaaataaatcgatccgagttgagtcaagctgaccacaaaccgaaccgagtacaaaacacgagcatttcatctagcctaacgagggcttcccgttttgccgtttgatcgtttcccttttcttgtcgccgttggttatcgaaacctgtgatgaaccgtaatcgcgcacagaagatcacatcacacgctgttcttgctttccttgatccccgcgaagaggctcgttccgccgttggatgtcttgcagcgcaccacggacggccgatatgcctcggcggacaggtcgccctcctccctgagaccgggacccgcacagcactttctgaccgctggcccgcctgtcagaaccgccgggcatcgtcgacgccgccgcttgcccccattaaacccccggtctcgaggcgattctcccgcagcgctacatcgccactagaaccctccccactctacgaagcacgaagttaacgcgcgacggcggtcacaccgccgccgccgcccaccaccgctcacggccggcggcgacgcgctgcatctccgcaccgcctcctgtccgccaaccccgccctcccatccccgtacgcgtccggcctgccgcagcttccccttcacccgccaggttcggatccaccccccgccgctcgtcctccgtctattagagggggctggacgggttgggtgtacaactcacacgtcctctgtacgcggataggggactcattttctggcaagcatatgcaaggattctgctgctctttaggctagattccatttttgttatgttgggacttttttgttcatcggggtgggttttaatacggtgcatctgttggtggttctatcctgttattctgcagtgggcaacactggcgttcgttggcatctgacatacgagagcttaccaaggacgaacacagtttattttccatgattttttaggacgaaatgctgtttaatttcgatgggttttttagggttcagctgaatccatgtgccccgtgtgtcagtttcatccctgggtgttttatcgatgttccgttagtcggtactgactcagtgtgaaaataaaactattcagcagtatagatggggttcctctgttgtgtcttgctttgtgctgacgttttatgtgtggcatttgtccagtttcttcagtttgtcaccaattgaatgaattgatgatgagccagggtgttgataaatgataagtgataggtcgatgtttgcttatgattgttttctgctttgatttctcttctatgtgctatcacttgctccttgttttttattcaactcgtgtatactctgagctgtataaatgatttggtaagatgcttcgtgcatgctaattccccttgtgcctcacgggtattttttcatagatcattaatgccttagtggttctggtttcatgttcttaacgggccactctgtatggtattatttctgttgaaacgtttagtttctgattgaccaatttggtgattttgtgatacttgataggctataagctgctagtgcttgtggaatggaagagccacagaaggacagtgggcaaccatcaaaaagttctgattctgagctagaagctatggtattggatgataatggagcgggaaaatcccatagtatggaggaaaacagggattctcctatagatgtcgatggtgggcagtcatctatggatgtggatatcaagggaaaatcatccctcagtgatgatgttaatggaaagtcttcttccgagccatattccaatgctccaattgacatgagtgtcgaaagcctagagaagttttgcaaagaagcgtcaaggtccttctttgatgaagttggtctgattagccatcagataaattcctacaatgagtttgtctcgcatgggctccaggagctttttgattcgcttggggaagtgattgttgaacctggctatgatccttcgaagaaaggatcaggtggctggaagcatgccatcatcaagtttgggagagtgaagcttgaaaagcctgtgttttggactggcaaggatgaaggttctgttgattttaaaccttggcatgctcgtctccagaatatgacatatgcttcaagacttatagtagaagtgactattcaggtcctgagtaatttcattcttttacatgttctttatgtatgccatggttttcccaagaaaaatatgccacctgggtgaaattgatatcagtgatgagggaaaaaagttacagaaatgcttgattatgaatggcatgaacccatgttagacaatacaaaattcagttcttttcttataagctatccgcctaatcccataaaccaataccttggctactgagcaatattgaccagcctgcatttcattttcatgaatttccctggtaccctaatcaatatagcatggttctaaatgatttagtattaaataaagtagcgcagcttaggactggagagtgattggtgttttgaggacatcccatcagtcatcagcactatagttattcttgttttctccatgtactggattccatttgaagagtattacatttacttattccttaagttttatgtatgatgaagctggagacatgaaatcgctctgctatacttgttgtggcgtcataattttactcacatttgcttaggttttatcatcactgattatatgtgggttatttttcattgtaccaggtttattctttggagaaaagtgacaaatctaaaacagggaatgatggttttgttcaaaaaaggaacttcatgaatgaaactcattggatatttattggcctccttccggttatggtcaaatcaaacttatgtttgctgcatagcctcaacgaaagtgagtgcctgttcgacgcaggtggatactttttggtcaagggaatggagaaggtataactctgtgaaatgttttcaaatcatctaatcgatcctagttgccatgacaccaataatgcgattagtcatcgataaaccccttttttagagttcgagggcagggtcgccttggcctttcgtattcataaaagacaagaaacatcctcttacagctctgagttaaaagctcaccaagcaaaatgagaaaggaaaaggagcagcaaagctgagtcccagaatatgagaaaaggcaccagaacgaacaccagccactactcaactaggaaaatcttagactactcattgcaccatctccatagcagcattaaacgaccatcaccactgccctgaagacgacatttcatccacttttatgttctcaggtggagtatcactctattcaaggtcatttataagcccaattaattgagcctagtcgaccctagtcatccatatagtcatcctgtatgtaccaggaccaatatatatatatatatatatatatatatatatatatatatactatataatatgcagtataaaggctatgtaaagcaagatttaagacaaaatagcaaagagcagagcattgaaggctgggggaagcttaccaagtatggagaaggtacaccactcgttggtgggggagctcatcatcgaaatcccgagagcaggacttgtgggcggtgcttgaaggctaggcacatcctgccgccgcttgactgaggcaggttggtgccttcccctgtgcggctgctcaagcttgtgctctttggccaccaaatacagggaagggacgtgttggcttcgacctctccacaagaagccctttcgaatcttgtcaatagctttcaaagcccattgaggaaggtcaatggccatggccaaataaacaatcattcctgtaagaacagactgcaccataactcttctaccagccttgttcattaaatctgccttccaccccggaagctgagctgctaccctatcaatgatagattggatggccgatctcggaagcttcttcaaggaggcactccgagatatttacaagggaagcttgatatctcacaaggcaacatctcctgtaaggtctcaacctcagattgaccacactaaataggaaagacactactcttctgaacattattttgaagtcaagaagcatctccaatcagctgcaaaatatccaagaccatatggatgtcctgggataaaggacgaagaaacagggcaacatcatcgacatagatagtggtccgatggttaagaaatatagatgtagggattgaagcagccattcagctcctgctgccatcaccaagtgacctagaacatccattacaagaataaataacataggagataaggggtctccttgcctaaggcctatcctgtagaaaatagtgttccctggtgacccatttaacacaatccacatagatgattaagagaggagaccactgatgatatccctccgaatctgtccaaaaccaaggtgcctcagaacttccaatagaaatggccaagagaccgaatcaaaagctttagaaatgtcaagcttgaacaaaagactagcagactttcgcttatgtagacagcgagcagtttgttgcgctaacatgaagttatcctagataaaacgccccttaataaaggcactctggttgagggagcccaattcatgtaatcgactagcaagacaatttgccaacagcttagtaaaatttttagcaaaactatgcaccaaactgataggtctaaaatcttttacaagatcagccccttccattttaggcacaagagtgataaaggctgagttgagcttatggaagttacagaactttctacaccagactgctggtgccatatgcaggcttgttgtgtttaagctatatatataggtctaaatgtgctgcagtgtcttattttgtcatatcttggagattctaatagattttcaaagtttaagtgataattattacaggaacaatgaagatctgctgatgatggtactccctgattatttgctaagttcatttggagtttccttttgggggtgtgactgtctgagttgtagcctttttactgcaaagataacatcctttaaatcatgtacattatttttcctttcatcttactatgtttctattattgttatacctgcaggtattcattgctcaagagcaaagatgtctaaggaggctttggattagtgaccgaccttgctggactatctcttttatgtctgaaatcaagcgtagacgtatatatattaaactagttgaatctacaaggagtgaagatttcagtgagagcaaaatcattaccatttcctttttgtatgcgacaatgccagtttggttgttgttctttgcacttggaatatcatcagataaggaagtgtttgatatgatagatatgcaagattgtgatgcttctgttatcaacacgatatctgcaactatcaaagaatctgataaactgtgtgaagacttccgtaaatcagataaagctcgtcaatatgttgatgagttggtaaaaagttcgagatttcctccagcggagtcctttgatgactatattgctaggtttctctttcctgatattagtggaaatagaaacaaagcacttttcttagggtacatggttaaatgtctgctaatggcttttactgggaagcgtaaatgtgataataaggatgatttcaggaacaaaaggctggacctacctggtgaattgcttggaagggaacttagggcacagcttaggctggcagagaaacgcatggttaaggccatccaaagagatttgaatagtgaccgtgagttacaagatcttgaacgttatatagatgcatcaattgttactaatggtctaaatcgtgccttttccactggttcttggtgccatccgtacaaaagagctgaacgatgctcaggaattgttgcgactctaaggagaactaatcctcttcaaatgatgtctgacttgaggaaaacccggcagcgggttgcttacgctgggaaagctggtgatgcaagatatccgtaagtaacttatttttcatcaaccaagtattgcatgtgcatcttgtgcttttgtatctcctaacgttgagtgacttaagactaaatccctacgtacaggaatccatcctattggggaaagctatgctttatgtccactccggatggtgaaaactgtggacttgtaaaaaatctagctgttactgctattgttagctcaagggtgatgcagcccttgattgagagcttcatttcttgtggaatgagtaagctgaatgacattcctactgaacacattcaaagaatggataagatctttttgaatggcaattgggtgggatcttgtgaaaattcagcttcatttgtatttcgattgaggtgcatgagacgcagcagtctgattgatcctcaggtgacctcttttttccatggctggtcactttctgctttaacttatttacagtctttactaagatgtttggtgtgcaggttcagtatatgtacactgtttttgttttagaagagtccctatttcttgtcattgattaaaaaaaaaatcaaattttatcttttgtatacattgatcaatatgacttgcttataaagcctgcttgaataataaaacttgacttgtgggggtaagacaaccctcgggtattgtattaagaagactttctcatatatgtcaagaaaatccctgaacccttcctcgaacacctgtcccacccatacacaatggcaccgtaggccatgtgagaatggccgcgacagcagctgggtcttagacctgtgctcgagggactggaggagtgttacttagaccacctaatcaactcagacagaggtccttttgcaagtctgcttgaataataatggttttcgttggctcctttgcaatgttgatcatctattacctatttttttaggataaatatttttttgtaatttggttaacaagtgagttaaaattttaaataggttaaaatcatttcctatgaagttaccaggatgttgtattagtttgtttggctcttttgcaattgtaaaggatatataccaggggtaccctaagtatattaataataaagatgttggcttgtgggcccaactcggactcggactcaggagaacccggtccacatgtcaagatgaagtctgcatggtcgaataaggcaagggagattgtaggatttgtgtcgtacctgagtcgtatcatcattgtaacagaaatacccgatttataagggaagtatccgtagcgattaggatatgttatgatcgccatcccgtgaacagccctattaaaattagttggttagataaacattcggttagttagtctcggataaagtttgttagggcttgttatcttaatcggttggattagatagactttgttagggtctgttatcttattcggattggattagtcttagatagagtttgttagttgttggtggctgctatctcagcctatatattgtacccctttggttaaggaagaaaccaagcaggcaagtaccttgtcgtgcttcccccacctcgtctactgtttggccatggtactgttcattgtctactgttcgtccgcgagtactgttcgcgcgtgaacagtatcacactttccccaaccagcagccctagccctaggacgacgtcacccaagcgctggggtcctggtcctcgaacctcccacccaccactcgtactacctccgtaaccctagttccaacatgatagggaattagggatacctgtaactgaaatagatcaggacttgaatgtccgagtccttgtctggtatggccacatgtttcttttccttgtaaccagaaaacagaagggcaatgcgccccagaagggcagaaaaacagaaaacagaagatcatgagaataaccaccataatactagatgtagggtattatctcatgacgagagcccggacctctgaatcttgtgtcctttgtgtctttactttcaattctttgatctcgcgaacaccatacaaattcaccgttgcaaaatccttgacagcaatcttgatgctttgttcccattttttgaggataattattttgttttcgtaatttggttaacaaatcagtataaataggtcaaaaccattttctttgaagtgaccaagttgttatattagtttgtttattattaatttctcaaattgtgctctgtctttcttttctgattcagttaactgctgaaaatttcctgcctatctcgactgttgtgtttgagtcatgtaattttaggttacttccttttctcaatgctttaatctcaggatgttggttgcttttagttgttgacaccttctcagtgctgcatactaatattccacaccaagatgttctttataatgttttatatgtttcttgtttcatcttgttaggttgaaattaaaagggacaagcaccacaatgaggttcgcgtgtttactgatgcagggcgaatcctcagaccccttcttgtggttgagaatctgaataaaatcagaaaacctaaggggcgctcattctctttccatgaattaatgcaacaagaaataattgagttcattggtgttgaagaggaggaagatatacaatgtgcgtggggaatcaggcatttgtttgagagtgaaggtgcgatatctagttatactcactgtgaactggatccttcctttcttctgggattaagctgtggtatcattccttttgcaaaccacaattttgctcggagggtattgtaccaatctgaaaaacactcgcaacaagctattgggtactcaacgacaaatccacacatcagagttgatactctttctcatcaactatattatcctcagaggcctcttttcaaaacagttatagccgactgtcttggcagatcagattatgcttcttttggaagaaaaaatgatttcgcgagaccagaatattttaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaaaatagactttggaaaaacagaaagcaaaagaggacgtgttgacaatcttgatgatgatggcttaccttacgttggtgcaagtcttcagaccaatgacattgttattggcaaagtctcagaatctggagaagaccacagtattaagctgaagcatacagaaaagggaatggttcagaaagtattgctttcagcaaatgatgaagggaagaattttgctgtggttactctaagacaggtaagaccttttctggctgcatctcactcacatgtcttgagatagattgggatgggaaattagttatttttccaccgcaccccaatctctcaacacatttgaatgaggtggatacgaatgcagccaaaagacctaaatgacatttgtcttagcaaagaattgaccattaatcaatagtacattccttgaattctcacttcactagcgcgcatacggatcttatttgacaatagaatgcagcattctgtaactgcattgattgtcagttaagcttgttacctgttttgtgtgtcaggtgttgttatttaacccagtagttatcttgctcttgagtgattattgttggccttcttgacattcctttttaactcaaaatattaatgaattatctatgcccatattcttgccatgcaattaagatgagatcatgaatgataagaaagacaagcatcaatgtgcgctcatgggttatgggtatttcatcctttctggttaaaataaaacttggtttgacttttattacctctcttttcttttacaacagttgtcactgttaacttttagggtgtaacttcgagacacacacaaatatttctaagtacatatattcgttgggtaccattgctggcagttctaacagtggtaatttcacactattgaaccatatatctagaaaaaaagtataaataattagaaaatcaaagctgacaagtattgtgaaacaggggtagtacatttttatggggttcagcactttaacatgattccatcgatccaccccacgtccccataccccaaaaaagtaatataggaatttggcttcttgttcttgacttttagaaaatgaatgagcccatatagggtgctggcttggttgggccagcagctcaactcaccctttttcatttccttagattagattccttcaacacttgtaacgtgacttctaattttctttgcgtccccaccttcacatttacaccacacgttactttttattgaccatttaaagttctctttgttgatctgatttaggttcggacaccttgccttggagataagttttccagcatgcatggccaaaaaggtgttgttggttttctagaatctcaagagaacttcccatttactcacgaaggtatagtcccggatattgtgataaatccacatgccttcccaacacgtcaaactcccggacagctgcttgaagctgctctggggaagggaatagcttgcaaaggtacaatgagatatgcaacaccattcaccacagcatcagttgacgttattgcagaacagttgcacaggtaagtgtttcttctaacggatgaatagctgcttgccttaattcagtaacccaccccttgcacatgaaacgaagatctgagaccctttcaaagggttgggcattttttagcctcttctaggtgaactttgtaattgttaagcttattaatacatcttataagaaccttggacgtcattaatgcaccctatgctctcaagtcttaactctgttagtactttactgcttattacacatacagaagaagaaaagggaaaggtagggaaacaatgtacacagagagagagaacagaatggctggtggccatcctcatattttgtatatgagtaaacatgtatcagtaatttcacatgtatctttttgtcatattttgcaccaaaatggtggaaacacacgagtttccttcccgtttcccttttacttgtattactatcagttgctgcttatctaacggagacatccatattggtaccgctaaatataaaactgagtgcactcacacactactatgttctcagtgaggatcttacttcagataatcaagtgatgtatctgattttttttgtgtgtgtttagacttgttttcgtctgtgacttgtttagttaattttcaagattttatgtatcttgttgcattgcagggctggttattcacgatggggatctgagaacgttctaaatgggcgaacaggtgaaagagtgcaatccttggttttcatgggccctaccttttaccagaggctgattcatatgtccgaagataaggtgaaattccgtaacactgggccggtgcaccccctcacgaggcagcctgttgccgacaggaaaaggtttggtggagttaagtttggagaaatggagcgtgactgcctcctcgcccatgggtcagctgccaacctgcatgaacgcctcttcctgcttagtgacttctcccagatgcacatctgccagacatgcgagcgcgtggctaatgttgtcatgaggtctgtccccggaggcaagaagatccgtggcccctactgcggcttctgcaagtcttcggagaacatagtgagaatcaatgtgccctatggcgcgaagctgctctaccaggaactcttcagcatggggatctgcctcaagtttgagacccaagtctgctagaacttgtagacctgcttgcatccagttattacatatgtacatacagctagcctatgaggatctccaagctggtgtgccggtgtgtgatgctggcatagtaaggatgggcgagctagaaaccctgttgtgtttatgtgctgttttctccctgctcatgtggtaaactatgctaaagtgaatgaacactcgtttcctgttccctctttgaatgcgctgtgttagcatgcccttttgtttgaagattgcgtcttttgtggagcaccttgtattgctccgtagggatcacaccccttaccgccggcgatggccgacgatttgagataagatataatatttctggtcgtccttgttaaagagttcatgcatatacagtacacaagaaatgtcgatcgaatatagctagtaaaacaacttcaagaaacatgtacatgcggttggatggatcctttctcatcgatgatttgtctgcattgattcatccaaatcaagatacaagaggcagcatgagatgatctgtctgtgtctgcattgatccaaatcaagacacaatagagggacagcatgaggacgaacagagacaaatccatcgccccgtgcttgagtttctccacgagctagtaagagatcagcaagatcctctctagctaactacctgagggaaacgaacagcaggggaggaccaagaagtgatgagtgggggaactccatgcgagccctctggcctctcctcccacaggctacatcttgaggacgaagaagaacagtcctcgatgcgtcttcacctagctgctgcttaatttacgagtgatgctcttcgatccaaaggtacttatactacaaatacccctccccctctctctctctgtctccatcgccccaatgcaaagccggtctttctatagctcatagctgctggaatttggacctggctttgaaacatgtcgtgcactcgcgttgggtttgaaagagatgacttgcgttgcagcgagcgagcgacacaggtcaggtcacactgcaggggggaagcgaagcacgagtgtacatgcattgaacctggacgccctctttagcttttgcgtttgggcatacagtatttttattttggccttctgggatttgggaatacgagtcatcgattccctcagtgtcgtcccgtcacagctttttttttccgttgcctttatgctgcatgcccattcagcagtcacgca

SEQ ID NO: 692 - DNA, 11486 bp, Zea mays
cagtttataaaaaaatttaaataaatcgatccgagttgagtcaagctgaccacaaaccgaaccgagtacaaaacacgagcatttcatctagcctaacgagggcttcccgttttgccgtttgatcgtttcccttttcttgtcgccgttggttatcgaaacctgtgatgaaccgtaatcgcgcacagaagatcacatcacacgctgttcttgctttccttgatccccgcgaagaggctcgttccgccgttggatgtcttgcagcgcaccacggacggccgatatgcctcggcggacaggtcgccctcctccctgagaccgggacccgcacagcactttctgaccgctggcccgcctgtcagaaccgccgggcatcgtcgacgccgccgcttgcccccattaaacccccggtctcgaggcgattctcccgcagcgctacatcgccactagaaccctccccactctacgaagcacgaagttaacgcgcgacggcggtcacaccgccgccgccgcccaccaccgctcacggccggcggcgacgcgctgcatctccgcaccgcctcctgtccgccaaccccgccctcccatccccgtacgcgtccggcctgccgcagcttccccttcacccgccaggttcggatccaccccccgccgctcgtcctccgtctattagagggggctggacgggttgggtgtacaactcacacgtcctctgtacgcggataggggactcattttctggcaagcatatgcaaggattctgctgctctttaggctagattccatttttgttatgttgggacttttttgttcatcggggtgggttttaatacggtgcatctgttggtggttctatcctgttattctgcagtgggcaacactggcgttcgttggcatctgacatacgagagcttaccaaggacgaacacagtttattttccatgattttttaggacgaaatgctgtttaatttcgatgggttttttagggttcagctgaatccatgtgccccgtgtgtcagtttcatccctgggtgttttatcgatgttccgttagtcggtactgactcagtgtgaaaataaaactattcagcagtatagatggggttcctctgttgtgtcttgctttgtgctgacgttttatgtgtggcatttgtccagtttcttcagtttgtcaccaattgaatgaattgatgatgagccagggtgttgataaatgataagtgataggtcgatgtttgcttatgattgttttctgctttgatttctcttctatgtgctatcacttgctccttgttttttattcaactcgtgtatactctgagctgtataaatgatttggtaagatgcttcgtgcatgctaattccccttgtgcctcacgggtattttttcatagatcattaatgccttagtggttctggtttcatgttcttaacgggccactctgtatggtattatttctgttgaaacgtttagtttctgattgaccaatttggtgattttgtgatacttgataggctataagctgctagtgcttgtggaatggaagagccacagaaggacagtgggcaaccatcaaaaagttctgattctgagctagaagctatggtattggatgataatggagcgggaaaatcccatagtatggaggaaaacagggattctcctatagatgtcgatggtgggcagtcatctatggatgtggatatcaagggaaaatcatccctcagtgatgatgttaatggaaagtcttcttccgagccatattccaatgctccaattgacatgagtgtcgaaagcctagagaagttttgcaaagaagcgtcaaggtccttctttgatgaagttggtctgattagccatcagataaattcctacaatgagtttgtctcgcatgggctccaggagctttttgattcgcttggggaagtgattgttgaacctggctatgatccttcgaagaaaggatcaggtggctggaagcatgccatcatcaagtttgggagagtgaagcttgaaaagcctgtgttttggactggcaaggatgaaggttctgttgattttaaaccttggcatgctcgtctccagaatatgacatatgcttcaagacttatagtagaagtgactattcaggtcctgagtaatttcattcttttacatgttctttatgtatgccatggttttcccaagaaaaatatgccacctgggtgaaattgatatcagtgatgagggaaaaaagttacagaaatgcttgattatgaatggcatgaacccatgttagacaatacaaaattcagttcttttcttataagctatccgcctaatcccataaaccaataccttggctactgagcaatattgaccagcctgcatttcattttcatgaatttccctggtaccctaatcaatatagcatggttctaaatgatttagtattaaataaagtagcgcagcttaggactggagagtgattggtgttttgaggacatcccatcagtcatcagcactatagttattcttgttttctccatgtactggattccatttgaagagtattacatttacttattccttaagttttatgtatgatgaagctggagacatgaaatcgctctgctatacttgttgtggcgtcataattttactcacatttgcttaggttttatcatcactgattatatgtgggttatttttcattgtaccaggtttattctttggagaaaagtgacaaatctaaaacagggaatgatggttttgttcaaaaaaggaacttcatgaatgaaactcattggatatttattggcctccttccggttatggtcaaatcaaacttatgtttgctgcatagcctcaacgaaagtgagtgcctgttcgacgcaggtggatactttttggtcaagggaatggagaaggtataactctgtgaaatgttttcaaatcatctaatcgatcctagttgccatgacaccaataatgcgattagtcatcgataaaccccttttttagagttcgagggcagggtcgccttggcctttcgtattcataaaagacaagaaacatcctcttacagctctgagttaaaagctcaccaagcaaaatgagaaaggaaaaggagcagcaaagctgagtcccagaatatgagaaaaggcaccagaacgaacaccagccactactcaactaggaaaatcttagactactcattgcaccatctccatagcagcattaaacgaccatcaccactgccctgaagacgacatttcatccacttttatgttctcaggtggagtatcactctattcaaggtcatttataagcccaattaattgagcctagtcgaccctagtcatccatatagtcatcctgtatgtaccaggaccaatatatatatatatatatatatatatatatatatatatatactatataatatgcagtataaaggctatgtaaagcaagatttaagacaaaatagcaaagagcagagcattgaaggctgggggaagcttaccaagtatggagaaggtacaccactcgttggtgggggagctcatcatcgaaatcccgagagcaggacttgtgggcggtgcttgaaggctaggcacatcctgccgccgcttgactgaggcaggttggtgccttcccctgtgcggctgctcaagcttgtgctctttggccaccaaatacagggaagggacgtgttggcttcgacctctccacaagaagccctttcgaatcttgtcaatagctttcaaagcccattgaggaaggtcaatggccatggccaaataaacaatcattcctgtaagaacagactgcaccataactcttctaccagccttgttcattaaatctgccttccaccccggaagctgagctgctaccctatcaatgatagattggatggccgatctcggaagcttcttcaaggaggcactccgagatatttacaagggaagcttgatatctcacaaggcaacatctcctgtaaggtctcaacctcagattgaccacactaaataggaaagacactactcttctgaacattattttgaagtcaagaagcatctccaatcagctgcaaaatatccaagaccatatggatgtcctgggataaaggacgaagaaacagggcaacatcatcgacatagatagtggtccgatggttaagaaatatagatgtagggattgaagcagccattcagctcctgctgccatcaccaagtgacctagaacatccattacaagaataaataacataggagataaggggtctccttgcctaaggcctatcctgtagaaaatagtgttccctggtgacccatttaacacaatccacatagatgattaagagaggagaccactgatgatatccctccgaatctgtccaaaaccaaggtgcctcagaacttccaatagaaatggccaagagaccgaatcaaaagctttagaaatgtcaagcttgaacaaaagactagcagactttcgcttatgtagacagcgagcagtttgttgcgctaacatgaagttatcctagataaaacgccccttaataaaggcactctggttgagggagcccaattcatgtaatcgactagcaagacaatttgccaacagcttagtaaaatttttagcaaaactatgcaccaaactgataggtctaaaatcttttacaagatcagccccttccattttaggcacaagagtgataaaggctgagttgagcttatggaagttacagaactttctacaccagactgctggtgccatatgcaggcttgttgtgtttaagctatatatataggtctaaatgtgctgcagtgtcttattttgtcatatcttggagattctaatagattttcaaagtttaagtgataattattacaggaacaatgaagatctgctgatgatggtactccctgattatttgctaagttcatttggagtttccttttgggggtgtgactgtctgagttgtagcctttttactgcaaagataacatcctttaaatcatgtacattatttttcctttcatcttactatgtttctattattgttatacctgcaggtattcattgctcaagagcaaagatgtctaaggaggctttggattagtgaccgaccttgctggactatctcttttatgtctgaaatcaagcgtagacgtatatatattaaactagttgaatctacaaggagtgaagatttcagtgagagcaaaatcattaccatttcctttttgtatgcgacaatgccagtttggttgttgttctttgcacttggaatatcatcagataaggaagtgtttgatatgatagatatgcaagattgtgatgcttctgttatcaacacgatatctgcaactatcaaagaatctgataaactgtgtgaagacttccgtaaatcagataaagctcgtcaatatgttgatgagttggtaaaaagttcgagatttcctccagcggagtcctttgatgactatattgctaggtttctctttcctgatattagtggaaatagaaacaaagcacttttcttagggtacatggttaaatgtctgctaatggcttttactgggaagcgtaaatgtgataataaggatgatttcaggaacaaaaggctggacctacctggtgaattgcttggaagggaacttagggcacagcttaggctggcagagaaacgcatggttaaggccatccaaagagatttgaatagtgaccgtgagttacaagatcttgaacgttatatagatgcatcaattgttactaatggtctaaatcgtgccttttccactggttcttggtgccatccgtacaaaagagctgaacgatgctcaggaattgttgcgactctaaggagaactaatcctcttcaaatgatgtctgacttgaggaaaacccggcagcgggttgcttacgctgggaaagctggtgatgcaagatatccgtaagtaacttatttttcatcaaccaagtattgcatgtgcatcttgtgcttttgtatctcctaacgttgagtgacttaagactaaatccctacgtacaggaatccatcctattggggaaagctatgctttatgtccactccggatggtgaaaactgtggacttgtaaaaaatctagctgttactgctattgttagctcaagggtgatgcagcccttgattgagagcttcatttcttgtggaatgagtaagctgaatgacattcctactgaacacattcaaagaatggataagatctttttgaatggcaattgggtgggatcttgtgaaaattcagcttcatttgtatttcgattgaggtgcatgagacgcagcagtctgattgatcctcaggtgacctcttttttccatggctggtcactttctgctttaacttatttacagtctttactaagatgtttggtgtgcaggttcagtatatgtacactgtttttgttttagaagagtccctatttcttgtcattgattaaaaaaaaaatcaaattttatcttttgtatacattgatcaatatgacttgcttataaagcctgcttgaataataaaacttgacttgtgggggtaagacaaccctcgggtattgtattaagaagactttctcatatatgtcaagaaaatccctgaacccttcctcgaacacctgtcccacccatacacaatggcaccgtaggccatgtgagaatggccgcgacagcagctgggtcttagacctgtgctcgagggactggaggagtgttacttagaccacctaatcaactcagacagaggtccttttgcaagtctgcttgaataataatggttttcgttggctcctttgcaatgttgatcatctattacctatttttttaggataaatatttttttgtaatttggttaacaagtgagttaaaattttaaataggttaaaatcatttcctatgaagttaccaggatgttgtattagtttgtttggctcttttgcaattgtaaaggatatataccaggggtaccctaagtatattaataataaagatgttggcttgtgggcccaactcggactcggactcaggagaacccggtccacatgtcaagatgaagtctgcatggtcgaataaggcaagggagattgtaggatttgtgtcgtacctgagtcgtatcatcattgtaacagaaatacccgatttataagggaagtatccgtagcgattaggatatgttatgatcgccatcccgtgaacagccctattaaaattagttggttagataaacattcggttagttagtctcggataaagtttgttagggcttgttatcttaatcggttggattagatagactttgttagggtctgttatcttattcggattggattagtcttagatagagtttgttagttgttggtggctgctatctcagcctatatattgtacccctttggttaaggaagaaaccaagcaggcaagtaccttgtcgtgcttcccccacctcgtctactgtttggccatggtactgttcattgtctactgttcgtccgcgagtactgttcgcgcgtgaacagtatcacactttccccaaccagcagccctagccctaggacgacgtcacccaagcgctggggtcctggtcctcgaacctcccacccaccactcgtactacctccgtaaccctagttccaacatgatagggaattagggatacctgtaactgaaatagatcaggacttgaatgtccgagtccttgtctggtatggccacatgtttcttttccttgtaaccagaaaacagaagggcaatgcgccccagaagggcagaaaaacagaaaacagaagatcatgagaataaccaccataatactagatgtagggtattatctcatgacgagagcccggacctctgaatcttgtgtcctttgtgtctttactttcaattctttgatctcgcgaacaccatacaaattcaccgttgcaaaatccttgacagcaatcttgatgctttgttcccattttttgaggataattattttgttttcgtaatttggttaacaaatcagtataaataggtcaaaaccattttctttgaagtgaccaagttgttatattagtttgtttattattaatttctcaaattgtgctctgtctttcttttctgattcagttaactgctgaaaatttcctgcctatctcgactgttgtgtttgagtcatgtaattttaggttacttccttttctcaatgctttaatctcaggatgttggttgcttttagttgttgacaccttctcagtgctgcatactaatattccacaccaagatgttctttataatgttttatatgtttcttgtttcatcttgttaggttgaaattaaaagggacaagcaccacaatgaggttcgcgtgtttactgatgcagggcgaatcctcagaccccttcttgtggttgagaatctgaataaaatcagaaaacctaaggggcgctcattctctttccatgaattaatgcaacaagaaataattgagttcattggtgttgaagaggaggaagatatacaatgtgcgtggggaatcaggcatttgtttgagagtgaaggtgcgatatctagttatactcactgtgaactggatccttcctttcttctgggattaagctgtggtatcattccttttgcaaaccacaattttgctcggagggtattgtaccaatctgaaaaacactcgcaacaagctattgggtactcaacgacaaatccacacatcagagttgatactctttctcatcaactatattatcctcagaggcctcttttcaaaacagttatagccgactgtcttggcagatcagattatgcttcttttggaagaaaaaatgatttcgcgagaccagaatattttaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaaaatagactttggaaaaacagaaagcaaaagaggacgtgttgacaatcttgatgatgatggcttaccttacgttggtgcaagtcttcagaccaatgacattgttattggcaaagtctcagaatctggagaagaccacagtattaagctgaagcatacagaaaagggaatggttcagaaagtattgctttcagcaaatgatgaagggaagaattttgctgtggttactctaagacaggtaagaccttttctggctgcatctcactcacatgtcttgagatagattgggatgggaaattagttatttttccaccgcaccccaatctctcaacacatttgaatgaggtggatacgaatgcagccaaaagacctaaatgacatttgtcttagcaaagaattgaccattaatcaatagtacattccttgaattctcacttcactagcgcgcatacggatcttatttgacaatagaatgcagcattctgtaactgcattgattgtcagttaagcttgttacctgttttgtgtgtcaggtgttgttatttaacccagtagttatcttgctcttgagtgattattgttggccttcttgacattcctttttaactcaaaatattaatgaattatctatgcccatattcttgccatgcaattaagatgagatcatgaatgataagaaagacaagcatcaatgtgcgctcatgggttatgggtatttcatcctttctggttaaaataaaacttggtttgacttttattacctctcttttcttttacaacagttgtcactgttaacttttagggtgtaacttcgagacacacacaaatatttctaagtacatatattcgttgggtaccattgctggcagttctaacagtggtaatttcacactattgaaccatatatctagaaaaaaagtataaataattagaaaatcaaagctgacaagtattgtgaaacaggggtagtacatttttatggggttcagcactttaacatgattccatcgatccaccccacgtccccataccccaaaaaagtaatataggaatttggcttcttgttcttgacttttagaaaatgaatgagcccatatagggtgctggcttggttgggccagcagctcaactcaccctttttcatttccttagattagattccttcaacacttgtaacgtgacttctaattttctttgcgtccccaccttcacatttacaccacacgttactttttattgaccatttaaagttctctttgttgatctgatttaggttcggacaccttgccttggagataagttttccagcatgcatggccaaaaaggtgttgttggttttctagaatctcaagagaacttcccatttactcacgaaggtatagtcccggatattgtgataaatccacatgccttcccaacacgtcaaactcccggacagctgcttgaagctgctctggggaagggaatagcttgcaaaggtacaatgagatatgcaacaccattcaccacagcatcagttgacgttattgcagaacagttgcacaggtaagtgtttcttctaacggatgaatagctgcttgccttaattcagtaacccaccccttgcacatgaaacgaagatctgagaccctttcaaagggttgggcattttttagcctcttctaggtgaactttgtaattgttaagcttattaatacatcttataagaaccttggacgtcattaatgcaccctatgctctcaagtcttaactctgttagtactttactgcttattacacatacagaagaagaaaagggaaaggtagggaaacaatgtacacagagagagagaacagaatggctggtggccatcctcatattttgtatatgagtaaacatgtatcagtaatttcacatgtatctttttgtcatattttgcaccaaaatggtggaaacacacgagtttccttcccgtttcccttttacttgtattactatcagttgctgcttatctaacggagacatccatattggtaccgctaaatataaaactgagtgcactcacacactactatgttctcagtgaggatcttacttcagataatcaagtgatgtatctgattttttttgtgtgtgtttagacttgttttcgtctgtgacttgtttagttaattttcaagattttatgtatcttgttgcattgcagggctggttattcacgatggggatctgagaacgttctaaatgggcgaacaggtgaaagagtgcaatccttggttttcatgggccctaccttttaccagaggctgattcatatgtccgaagataaggtgaaattccgtaacactgggccggtgcaccccctcacgaggcagcctgttgccgacaggaaaaggtttggtggagttaagtttggagaaatggagcgtgactgcctcctcgcccatgggtcagctgccaacctgcat

SEQ ID NO: 693 - DNA, 13811 bp, Zea mays
gatacaaactttttctcagctgaaaaaaaccgcaccccaggcagcggacgggccagcaggagggcggcgcctgtccagtccagagctgtgaaagagacactgaccggtaggacccagccaaatgggaaggcacgtcagaacagagccgcaaagctgagcaccagcgggcagttgcgattgctattggtgaaacgcaggaggaactcacggcccgggcgcacggccacggcgagcaaagagagcgtccactgtactgtactccctgcttctgttctggttgcctgcctcctacagtagcatataaaggacagcaaaagcacactcgcctcgcctcgcctctccggctctcccgtcctcggtcgcaacgcggcgtggaaaaccccaaccggcgccggtgcggtgcctgcaccgcgccgtagggtttccgcctcgcctcgcctcgcaaccggcgatcgccggcgcgcaaaggtaagcctctccgtcctccgtccatttcagcgccccgttgccacggccatctcgcgctcacaccgttccggtccgcctgctgcgtggcgcaacgcggcgtttcctctgctctcatgggcctgcactgccaggactggatcgctagctcgcggcatgggctggtgtggtgcacgcgtctccctcgaaaaaaatagaccgcttttttttccgtttctttgtttggttcgcggcgagtgctttggagcccgtgctccctcgccgccagccgcgcgtggttttggcgcttcgagcatcgtcgacgtcgtggccttaggtggacgggacaccccgcccctgtccttgttattttgtgtgcgtctcatggccggggtgtggttttgtgttgctagtgcggtgctgaattgttgcggggttttggtggtgccccgtgatcatttgatcgggacgcgtggtggcgagccctcttctgatttctaattcctaagatgatggaaggttgcgaactcgccatacgtgatgatgtggtgggcctgcctgcccaaatcgccataaaaaaaggaccagagagggggacagtggtagaaaaacggtgcattttgctggaaaatctttttttcttttggcgtgattggtactgctacgcctgtaaggtgctccgtttaggtagaattctgtgaagtggatgtctgatgtgtcagttttttataaaggcagcgtctttgcgcatgcatctgcctgagaaattaacctattgctgtttcatttgcggaatgccaggtggagccctgggcgcacatcttatactgacctatctcttttggttaagaaattgaaaagttgtgtccttacacaaatcgtgtatggtttcagtgtttgttgctgaatgaatgccatgtggatgcagcttttctgatcttctggtttcaaaattgtgcaattccatgatgactgtgctgattatgttgtttccctgttctactgtaaaggaagggattttgttgacgccgagtgccagatgccaattgtttagccatggggaaaccacaaaccgatggtgaccagtcacctgtaaactcagatactgatgtgatggattgcctgaacttcgatggccatggagatgttgaagacccccacaaggaggttgcaaaaggggagcagcagccttctggcgaagttgatgaacagcagtctgttatggatgttgatttgacatgtataacatctgtgggagatgaagggaatgaaaagcagaatgctatggatgtggatttgaaagaaatactatctgaggaagatggaggggaaggaaaggcttcttcagatctaccctcacaagtaccagtggatttcaacgttgcaagcctcgagaagttctgtaaagaagcagcaagatcgtttttcagtgaaactggactggttagccatcagataaactcgtacgatcattttgtctcccatggactccaagagctctttgattctcttggggaaatcactgtggaacctgattatgacccttcaaataaacatggtgcttggaaacatgcaactgtcaaatttggtagggttaagcttgatgagccagtgtttatgcttgaaaattctgaccttgaagagcaagatctcaaatttaagcctagacatgctcgcctccagaagatgacatatgcgtctaggatgaatgtggaaatgactgttcaggtcaggatgtcctaattcatgttacatatcaagtaaacagtaggggtaaaatattatgtacctgttaagaaagactaaactatatataatataaatggaaaaattaaaaagatatcccagaaaagctttcttattctcttaactagtatggatgatgatgtgaccatttcagcctttttcttatatttcataaatgacatggaaattagtgagattaagctcctcctcgagttcatttttaactttccttttgatggcgcaatagccataatgatgtcgcttatgttttccccccttactcagcctccaaaactcatgtagactttgaatgtagctaccactgtggcttggcattctgcttgtagtattgccatgtttgatataatgagcagcagatgtgattcaaattattctggcatgtgtaatcaagttatgaccttgatctttgtatcaataagatttctactgatattttaccatctgaacaattaatgttttgactttattaggtttatatattcgacacaagtgacaaagccaaaactggcaaggatacacatgttcataaaagagagataatgacagaaactaaacaaatcaacattggattgttacctgtaatggtgaagtcgaatttgtgctggctgcataaatctcaaaaaggtgactgcccgtttgattttggtggctactttttgatcaaaggaacagaaaaggtaccaccttacatgatccatgctgctcattcaattctcagcaaatgtatttgacaaagatcattgcattatgcattctgcgtttagttggagagtcaattagaatggagtggttccattctagttttttagaatgtagccgttttattctccgtttggcaagtagaaccgagccactttattttttgtttggttaaagagtaaaatagagcggagccgctccgttctttgttgttggagagccatatgagtgtagagggaagaggaaggagagcactcgcgtctgagagagcgctcacatccgaccattttggtggagtgagagcactccaactatttatggtaaatttctatatggagattccaggagccgttccgctcctcttttgttggaaaccaaacatccaaaaaacttgaatggagtcgctccattctcctcaactcttcaaccaaacacacaatttcttatagattttgatggtgctgcaaatatattatgtatcgggtgaggcgtgcatgtaagatatttagtcagcagaaaagaggttttatggttcataatacatgcggtgactctatatggcactgctatgcaaatgccctacacgcttactatattgcccatctttttcaatagtttaagtttggccattggtgaactaattagtgcatgaaacttaatatgttgtcagacacagaggttttgagttgagacctggttatcacaagtttcacaaagggcgatgaggaaagtgaagtgtattactgtgttacttacctttcccaatactaaaaaaactcggccggggaaggaaagactactctcctagtattatattaagaagagacgaaacatggtcctggccgagaaaaccctcgaaccctagaccccatcactaacgggcagatcaattgtccactctgcaacggcccagccgtagggtggcgcacaggattctgttccccgagagctggcggggcatagtgaggggatttttttaaccaaacctgaaattcacccctgagggggatcaaacccaggacctgaatgtactactcgaaagtctcaaccattacgctagaggccctttcgcacctttcccaatacttaagggagagatagatgatggagactattatggcctgtcatacatatgttttgtgaaatttcaggctacctcaaatgaagtttacaaattttagcttgacaagtgttgtgataagtattatatgcgtgtggtcaaagttcaaatcaaatatttatatcatagttttcagatcgccttatcgcctgatcgatcccactgggcggttagtcgcgatcaggcgtcgatcagggcgattagtcgcccttgatcgaccctaatcgtcctcctagtcgtcctgtgtattccaggatatatatatagtcatatatataacactatatatatatacttatatagtgtagactatagagacttgcagcagtataaatagtccaatattcaatacttgaatagtctaaaacagaagtacatccagcttactagaccaacacaaggcctccataaggagtgctttgtacctgggtccttatggccctttattttccctctactttaatatatgggtgcgcagtcctcctgcgctctttcgaaaaaaaaacacagcagcaacaaatttatatgaaactgcaagtctataacttactagaccagtagaccatgaccaagaaggcttcagatgaggagctctccagtccctgtgttctcttttctccgagccgatgtagagagaaagatgttgctgtgctggagccttggagggagagagaagggtgaagaaggaagagggaagggagctgtgagagagtagggtgttttctgattttctcccagccgtcagggaagctgaaaagacaggtaaagctgggggtggctacctctattaatcatgggccagtccagtcaaacagactgttagactacccgatcacagactggactgttggggccagtctagactgttgtagtacctctattaatcgtgacggctcctaggcgattaatcgttccatatcgttgcctaatcggacgatatggacgatcagtaacactaatcgagtcgaacaccctaatcgagcacagagaaacgatcagcccgactaattgcgactaatcgattagaaaacaatgatttatatagtaggacgatggtgcttcatatttatgcatggaaaatgttctgtaaccttgtcaagaatttctgtagttaacaaattatcattgaagttaagaagtttttacctttttgatattgaacatgtttgacaccatgtctgggtgaagcatatctcattatgattgctttaaattctgtaggtattcattgctgaagagcaaaggtttttatcaaggatttgggtcacagaccaccccagctgggatgcaagttacctatctcagatcagacgagaaaagatcaatataaaacttgttccgtccaaaagcaatgaaagctgcaaagtcataaacatttgcttcatgggtacgattatgccaatttgggtagcattttttgcacttggtgtatcgtcagacaaggaagcttttgatatgattgatatcctagactgtgatgctgacatagttaacataatatcattaactattaaagaatctcatgaagaatttgaaggcttccgcactccaggtagagcccgtcaatatgttgatgagctgatcagaaaatcaaagtttccgcccaaagaatcctttgatgagtatgtttgtaggtatatgtttcctggtgtcaatgggtttaggagcaaggcacttttcttgggttacatggtcaaatgtctgctaatggcatactctggcaatcgaaaatgtgataataaggatgatctccgtaacaaaaggctagatctttcctgccaattgcttcggagagaactctggactcatattaaaagagcagaaaggcgcatggttaagctcatgcagagagatttgagcaatgatggcaacttgcaagaccttaggcgttatgtggatgcatcaattattaccaatggattgaaccgggccttctccactggttcttggcggcatccttataaaaaagaaaggtgttcaggggttgtagcaacccttcggagaacaaatccacttcaaatgatgtctgatgttaggaagacgcgacagtggtttgcatatgctggaacggctggagatgcaagatacccgtaagttccctgttcattcgcacaaaaaaaaaatgcgtgcctactctcttccttttctaatatccatgtgcaagctgactttcattttgcaggaatccatcctactggggaaaattgtgttttttgtccaccccggatgctgaaaaatgtggatttgtgaaaaaccttgctgttactgctgtggttagttctgtagtgaggaaaccgttgattgatacatttgtttcttgtggaatgaagaaactggatgatatttctctacaagatatttctgggaaggacaggattttcttgaatggaagcttgctaggagtatgtgcagacccacacgaattgactttgcgtttaagaagcttgaggcgtagcaagctaattgatcctcaggtctgctcagtttctgtctctgtcaaactaacgattaattgtcttgaacctcagttttcagaatcaggatagtgtcttactcccgttcgtggtctttgaaaactctcctaaaccattattcatagtttcaattatttttcaatatattttaccttgaactgtgatgagtcttgtttccttcatgtatcgtgatagatttcactgcgtaataagctattgattactgaaagttgtttcttgagtatagttgtgctcttgtatctactggttaaaaaaatttcatagcaattatcaacaagggcagacctatgccgagactcctgcatgagttgggactagggaagggataaattaaggcaagccttctctgcaattgcggagtggttgcttaacctttaatatcgtactcactttaattatcttgtgattagtcgataccattctaattttctcttgctcattactagttttcctttaattcgttcaagaactagtttcctttacataatctaaaaaagaaagaaagacctttacgtggtggatctgatttcatgctcatggaattctgaactgaattggtgtatgtttatgaatatccaatatatatttttgccactaggtggaatatggatgttttgttacatgtactatttctgcctcaatggaatacttaaaagtacatatgttgcaacaagttggtagtaatactgataggttccttgaccttgttgtggttgtgaaatgcggaaggatgtgagattgggggtagggatgcgtaagctgatatatggaccactcacgaacaaaggccacaacaacgagggtgcgaacaatggtcatgtaagcaaaagtctcattataatcacgctcatgtttctgctagaaaccacggataactagacgagccttgtaacgctaagagaaccatcagagtgggtcttaaccttatagacccacttacaggtgatatgttgaacatgaaggggatgagcaacaatctcctaagtgctaatatgctcaagagcgccaatcccctcagacatcgcaacttgccattcaggatgaagaatagcatcaccataagaagttgtctcatgttccttctttatgtggcttgttgcccataaccgttgttggacagcagaccggccggctaaaaggaaccttccccatcccactctttatgttctttgcgaccagggaaaggaaacttttttttgaaaggaagcggcaaaagacttgcctcttcaatatattagaagagaaatagataacagtcttcagaagacggagcaaaagaaaaaaaacaaaaagaagaaaaacatacactaactcaatctaacatacactgcagctcccaatttgatctttcaccaattgcgtaacctggatagcagatctttgaagtctctgaaagattctgttatttctttccaaccatatattccaccaaaaagagatgaggagtccatcgaaaatcttctttgactccttgcagcaacggttccttaatctcttccaccaatcatacaacgagccgaggtcagaaacgccacttagaaaggatagattggcccaagataggatcatgttccaaacctctacagaaaatgggcagtctttgcctaaatgaggcatactttcttgtgataagttgcaaagacaacaaattggattgcaaggccatccccgcttttgtaggctgtccgcagtcagaactctgttatgcaacatggtccgcgcgaaaaaacgacattttggctcaattctcgctttccagataggagaaattttgattttacaaaaattcgttgtaaactgaattttgtatgcactacttgaactataactcccatccgtcgtccacctccataaaatagtatcgtcgagatcattgagttcatgagtgttgttgataccttgctagagggaaatgaattcttttatctcatcctcatgtgtgtaaggagaacaaaagtgcatccagcgattgtttgtaagggcttggcacactgagatatttttcctctttgctttcatgaataaggttggcgcaatgttctttggcgtctgaccctgaatccagcttgatctccagaaattagccattttgtcatcaccaattgttacaatcgtagatgcattaaatagatcgacatctgctttatcacaaggtaattgcaactcagtccatgctttgtctctattcgtccatcgtagccacagccatctaagccttaacgctcttgcaaagcgctctagatcgagtatgccaagacctcccttattctttggcaaacaagttgtagcccaatttatcaggcaatgacccccactacatgaatccaaattttctcctttccaaaggaagttccttcttatcttgtcaatccttttaagtaaccatttctgagctgggaaaacagttagaagataaatcagttgcgctgtcaacacagatttaaccaaggtttcccttcctgcctttgaaagaagcctacctttccacccagcaagccttttattgattttctcatttagaggttgaaactctattcttttaatattcctgaagtgaagcggtagcccgagatacttgccagggaagttagagtacttgcctggaaaaacttccattaaatttgaccttaaagattcagggtaacgtattgggaaaatctctgttttctcaaaattgatctttagacctgaacaccattcgaaagcttctagaattctttttagaatgctctaacaaacacccctgcatcgtctgcatatcgagaacagcgaaactttgccccattgggtaatacctggcccagtagcccctcatgagctgccctttcaatcattcgttttaggggatccattgcgaggatgaagagaaaaggcgatagtgggtcaccctgacgcacccctctcatgtgcttgatttctttggtttgctgaccattaatgatgattttggatgaagatgagccaaggatggtagcaatccaatctctccatttttgggtgaagcctagggctcttaagacgtctagaagatatgcccaattaagagagtcaaaagcttttgatatgtctagcttgacaaatagggctgcttgtttgctcttgtgaagttttttaatcactttctggacgtagaggaagttatcatgaattgatcgtttttgaatgaaagcattttgggtagtggagacaatttcattcatacgcggaggaaactattaaccagcttctcgttggttgtgtgtttgttagacaattttagttctgtttttttgcaaaggctgggtatgttcgtccttacacctcaacccgggatggagtccttcatggaatggtggctgtaggttgtttcggaggcagataaggctttgaaggaggggttaaactctctcatcatattaggggcatggatcttgtggaaacacaggaatatcattgtcttcaatggagcaacccctcatctctctagtctctactgctctctccattgctggagaggaagtctggtgctgaaacaaggccgatgctaaaggcctccagctccagttggcacaggaggatgaggaaggtcttttgccttagagtcgtcaggtcgctggttggtgctgttgggcttagcccgctctctgaagtccaaccttgtttgtgtgtgtgtgtgcctaagcctttggccagacggttgtatctggtctattttagacctttctttcttcttgatataacgatacgcaacatcgaaacctgacatcgctgataccagttcgataggttccttgaccttgtcgtggttgtgaagtgcgtagggacgtgagattgggtgttggggtcggaacctctgatttcgagaaggcgtcgtggtagctagggtatagatcagtagcgcaatgacaactctcaggcaaagctccgattgacattgcacctagcttgtaccccctggcatggcgcaaaaatagatcggtggctgaacaattggttaacctcaattggacgagaggtctctggagaatggaaaatgttcaacagatggctgaattcatacaattgtggaaccatattgagggggtgcagctcaatgaccaggaagattgcattcggtggatatggaccgagaatggagtgtactcttccaaatcagcttatcttgcacaattcaagggctcttacagtgctttcaaagaaaaatctatctggaaggcgcacgccgaagggaaacataagttctttgtgtggctgctcattcaagcagagatcctcacagcagataaactaagtcaaagaaattggccatgcaatcctctgtgtgtcctttgcgatcaagagccggagactgcgattcacctttgtctcaagtgcccttttgctttggaagtgtgggagttagtcagatcgtggaccaataatctgatcatgccgcccagctcagatattcagagcttcgattcgtggtgggctgttgtgctccaaaacaaatcgaaagaagaccaactcactgtttcgggtttgcttatgtacttcacctggaatatttggaaggagcggaatcggcgtatttttgagggcaagcaagcatcgacacaagtggtctttcatctggccaaacaagaaatggcgttgagacgagctgcagttgggcatccatgtgtagtgtaatgtcttctcttttttggattgtgtttgagtgtttttcgttatatgtaataacaactttttaagactcttgtttcccttctctccttaaatgaaatagcagagctcctgcactaagttttcaaaaaaaaacaaggaaacataacacgtgggtggctcttgaatcctggtgaagataattgtgttgtttgccttcatctggctacatggtctctatatttgtagtctctatttatagtctctagaggacttatttttccaagctaactagggtagccctaacaaatagttctattttgtaacaaataattctatttcctaaacgaggaggagcccttgtcgatttggattctcttttgatcttttcctaataaatacttctatttcctaaacagatactgtttatgcctattgcatgtaatttgagcccaatacctgcgtgggccgttttatggtgcgcataagatataccgatcataacaaatattgttacttttcctatttttaacttgaataggttgaaatcaaaagggacaagcaccataaagaagttcgtgtattttctgatccaggcagaattatgagaccacttcttgtagttgaaaatctaagaagaatcacaagaccaaaagatggactatactcttttcaggaacttatagatcaaaacatagttgagctgattggtgttgaagaagaggaggatatccaatgtgcgtacggaattagacatctattctccagcagggagaaagaagactggtcttcttctggctatactcattgtgaacttgatccttctttcttgctagggctgagctgcagtctcattccctttggcaaccatgataacgctaggagggttcagatgcaagctgaaaaaatatcacagcaggctatcggctactcccctacaaattctcagtacagactggacaccctttcacatcaaatgttctatccacaaagacccttgtttagaactgtggtgtcctacggtcttggagaggcgaagacagactgcagctccggacgaaaagacgacttcaacacaccagaatatttcaacggacaaaacgcgatagtctcagtgaacgttcatcagggattcaaccaagaagactctctggtgatgaatagggcctccttagagcgtggcatgtttcgcacgctacatttcaagagctacaaagcacaggtcgagaacaaagagatcacaaggcgtctcaagcacagggaaaacatcaatttcggtaaagtgcagagcaagagggggaaggtcgacagtctggacagtgatggcttaccatacgtcggagcaagtcttcagagtggtgacattgtcattggtaaggtcacggagtctggtgaagatcatagcgccaaactgatgcatactgagaaagggatggtggacaaggttgttctttcggcgaacgatgatggggttaactttgcaactgttactctaagacaggtgagtaataaacctttgcaagattattctgcatgcccaccacttattgtcaatcttcctagtgattagtctaataccccgtttcaattcagtctcgctcgccatgcgtcggagacaagtttgccagcatgcatggacagaaaggagttgttggcctgttggattctcaggagaatttcccattcacttcccaagggattgttccagacatggtcataaacccacatggttttccaactcgtcaaactcctggacagctgcttgaggctgctctggggaagggcatcgcccttggtgggaaggtcaggtacgcaacgccgttcaccactccgaccgtggaggtgatcgccgaacagctgcacaagtaagtccttatgaaacatgacggattcttatggagtactttatcaaggaaaatgccatagctgcagccttcttctcatgtgtcatgccaatgccacaccttgtcgcttcggtttgcagggccgggttttgcaggtggggtgaggagagcgtgctgaacgggcagaccggcgagcggatgaagtcgctggtgttcatggggccgaccttctaccagcggctggtccacatggcggaggacaaggtgaagttccggaacacgggtccggtgcacccgctcacgcggcagccggtggaggacaagaagcggttcggcggcgtcaagttcggggagatggagcgcgactgcatgctggcgcacggcgccgccgccaacctccacgagcggctcttcaccctcagcgacttctcgcggatgcacatctgccaggcctgcgagcgggtggccaacgtcatcgtgcgggccgccgagggcggcggcggcaagaaggtgcgcgggccctactgcttgttctgccgctccgcggagcgcgtcgtccgggtcgacgtgccgtacggctccaagctgctgtaccaggagctcttcagcatgggcatctgcctcaagtttgaaaccgaggtccgctagaacgaacgccatggcagttcaccagtgagactccctcgatgcatatgcaagtatgcaactgcactgcctaggatcttggtgctttatgggctggtgttgaaacctgcagttttggcggcacgattttctgggcatgcattcagtagcaggcactggttgatactgtgattc

SEQ ID NO: 694 - DNA, 5413 bp, Zea mays
cctgtaaacccaccaatccatgctgtccatgcctagaaacctatctcttttttttttcacttaaaaagaaaagaatgtagtacttttctgtctctctaaagtagtgctattctggattaaagtacacatgctgaatgataaaaccataccgcagtccatatgtaggaaaccacaaagtttggcctattctgatgatagctgcaggctggtccttggacttgggccaacaccaaatctttattctgccgatagttactcatttggtggaaacgaaacttatgaatcttctagtttgctcactcaatattgtgccacagctgaacctggtttaatgttgggcctttcaagatgcagctcgagaaatttacaatctgcaacaacgagtggtaggaagaattattcacctgtaagaaagactggtatcatctttccgctcattgatgagggttcaacttcagcaacaaggaaacaaggtgctgccacttctgttcgtgccaagatcaggagacttttgttttaatagaacatctccagacactgatggccaacagcatgagggaactggatgtggtactgaaagcgatcatgatagatctctaaatcatcacgaggtatccattacagctgactgttcgtttgctgcaacttctggcacaagtagtgagcagaggagtcattagcgtcatccaaagaaatgcaggtttaacgggtgttggaaaggtgcaaggggtgcatcaggagtttgcatttctcatggcggtgggcagaggttgcaacaaaggtgctgagagtcggacaacattctgcaaggctcatggaggagggagacgatgccaagagttaggctgcaccaaaagcgtggcagggaagacagagttctgtatcgctcatggtggtgggcgctggtgtgggatcaaggaatgctcgagtgcggcaagggggaaatccggattctgcctaaaacacggtgaagggaaaaggtggaggatcgagggttgcactcgcggtgctgaaggtcattctgggctgtgcatctcacacggaggtggccgccggtgccagcacccgaactgcggtaagggggcgcagggaagcaccatctcttgataccacatcaggcgctggtccctggctcattgaagacgtcctccccttcgtgtggtctagaaggcaacggcccggatgacggagcgagccggagccagagatccggagtgaaggctgcacggtggagggctcttgtccatgcttggagttggaggcaacctgggaagcagttctaatgtttcaaaagcctgaaacgagaagcgtgtgacaaagaaaagaactgaggctattctgcatgcgatgtaacatatgcatgatttttcaattattgttgttatatgtgttgtcattcgatttcagcttttctcgttgccgttggttgggccgtctatccaaacctgtgctgtgataaaccgtgatctcgcacagaagatcacatgatgcccttgccctccttgatccccgctaaggtactcaccatgaaaagccgtatctgtctcggcggacaggacccgctcgtcactgagaccgggacccgcagagcattgcttgaccgctggcccgcctccgcctgttagaaccaccgggcatcgtcgacgccgccggttgcccattaaacccccgtccccgtctcgaggtgatcatcccgcagcgctacaacgcccgaactctccgtccctcactctcagtctccgacacattctacgaaccgcctcccactaccgctcattgccgccggtcgccggagacgcgctgcaccgccagctgtccgccttcgcccgccgaccccggcctgccgcagcttccccttcacccgccaggttcggatccaccacccgccgctcgtccgccgtctgtgagagtggggttgatcagatactcttgccagatcctttgtatttcttttgtttaggcgaaattcctaactaaaaaaacaaaatgaatattatatatatatatatatatatatatatatatatatatatatatatatatatatatatatatatatatacacacacacgagattttcctatccctaaaaaagatgaccccttcttcctatacattactaaggaatagtagtctttcttttataggtgaaatttgactggattttagtttataccccttccttgattatatgagacaaaaaacaagaaatgacaagaaagttctatatgaataaagaaatagaagaaaatgcgcgcggatgggggacccatttgctggtatatgcaaggataccactgctcttagcgctagcttccatttttgtcgttcttcagcgggcaacactcactagtcactagggaatgtaatttggtttggaagttcgacggattcaaagatgccgaacattgattcggatagaattttcggatattcggacttttttttttgcagataacggatacatgtacagatatatgttcggatatcggattcgaatacaatatgtttgatatccgtcggatatcgaatatccggatatcttctcggatatccggatatcttaccagatagttgtgtacattttattgatattttgcagaaagaaattaagaatacacaaatatcatcggaaattcatgaaattttatggagacataacatatgtccacatataatcttaaaaaatatttggaccataacatccacaatatatcagtgtctatttcatttcattttcacttgttgcgtaagttacacgagaaatcactctaaataaaattcatgaaaatttacgaagtagtggcatatgtacacacataatgctaaaaactgtttagactcagagtggataaatgattacaaccataatatatgtgtaatgatgtcttacatggtatccgataaaaaaattattaacgatgatatctgtgtccgactagttccgtattcgacatgcaactatccgtatttgtattcgagaacatctgtattcgtatccgaagctacccgtattcgaatttgaatccgaatagaaatatgaaaacaaacatggttttggtgatatcggtctgtattcgatccgattacatccctaacactcacattggtcggcatctgagatcctacgaaggacgaatgcagtttattttccatgattttcctgagttcagctgaatccctgtgcccccctatgtcaatttcatcccctggtgtcttttgattactctttagtcggcactgacttactgttaaaaaaaacatccggcagtattgatggggtttctctgttgtgacatgctctgttctaacattttatgtgtggcaattgtccagtttcttcagttcaccatcaattgacgatgagccaggttgttgataagtgatagattgatgtttatatatcattgttttctgcttcggtttttctgatatgtgctgtcacttgctccttggtttttatgcaactcggtgtatactgtataccctgacctttataaatgatttaacaccatcctaactccccttgcccttcatgaccgtattttttatagatcattaatgcgttagtggttttggtttcatgatcttaacagcccactctgtatggtataatttttgttgatacgattagtttctaattgattaatttggtgattttgtgatacttgctagggtataagctgccagtgcttgtgtcatggaagagctacagaaagacagtgcgctaccatcaaatagctctgattctgagccagaagctatggaattggatgacaatggagcaggaaaatcccatagcatcgagggaaacagggattctcctatagacactgatgaaggccagccatctatggatgttgatattaagggaaaatcatctctcaacgatgatgttaatggaaagtcttcttctgagccattttccaatcctccaatcaacatgagtgtggaaagcctagagaagttttgcaaagaagcgtcgaggtccttctttgatgaagttggtctgattagccatcagataaattcctacaatgagtttgtctcgcatgggctccaggagctttttgattcgctgggtgaagtgattgttgaacctggctatgatccttcaaagaaaggatcaggtagctggaagcatgcaatcatcaagtttgggagagtgaagcttgaaaagcctgtgttttggactggcaaagatgaggtttctgttgattttaaaccttggcatgctcgtctccagaatatgacatatgcttcaagacttagagtagaagtgactattcaggtcctgagtattttcattcttttacatgtccattacttgctctttataatacaatgttttccaaaaaaaagtgccacttgggtgaactataaaatcagtggtgaggaaagaaaagttacaaaaatgcttggatatgaatggcatgaacccatactatctattgtaggcaacacaaaattcagtccttctcttataagccaaacacacaaaccaatgccttggctactgagcaatattgacatgcctgcatgtcatttgcttgaatttccctggcacactaatcagtatagcatagttctaaatgattgaatattaaataaagcagcctaggattggatgtgtgattggtgttttgaggacatcccatcagtcatcagcactatagttattcttgttttctccatttgctgaattctatttgaagagcctattacatttacttattccttatgtatgatgaagctcgacatgaagccaccctggtacttgttttggtgtcataattgaactcacaattgtttaggttttatggtcacctgattatctgtgggttatttttcattgtaccaggtttattctttggagaaaagtgacaaatctaaaacagggaatgatggttttgttcaaaaaaggaacttcatgaatgaaactcactggatatttattggcctccttccagttatggtgaaatcaaacttatgtttgttgcatagtcttaaggaaagtgagtgcctgtttgatgcaggtggatactttttggtcaagggaatggagaaggtataactctgtgttctctgttgttaatgtattagtatgtaggaactttcaagtgtccttttgttgctggcatgggactatagctttcttagaacccattcagaaaacatgtacatgctcataagaggggggggggtccaaatatgattgtagctatgtaaaataggattctattgtatcgaaggatactttggcacagcatccgtttgagttggtctcctggtgccatatgccgcttcttgtgtttaaactatatataggtctaaatgccgaagtaccgatatgtgtatcagtattggaaggatatggatgcacggatacagcagtttttcaaaaaaaaaaaaa

SEQ ID NO: 695 - DNA, 7105 bp, Zea mays
ccaaatcgcctcaccaaccgaccgtatcgcaggcgcattcaatgcagggatcgtctgacaccttatcctgacacgcgtgcctcagtcggcaaggtcgaagtgaccgcagtcacttcgccctttcactgaccgacctgacaggaaaacagcgccgctcgccccgctccgactgctgtgccacccaccagggtgagactgacgacaaccaagttcggcctcgggcgcaacaggaagctccgcctcgcccgaccttaggcctcggcctcggaaggaggtcttcgcctgagggctcggcctcaacctcggcctcggaaggaggtctccgcctcgcccgaccccagggctcggcctcaacctcggcctcgggaggaatcgtgtcctcgcccgaccccggcctcggcctcaggagaaacctccgcctcgcccaaccttgggctcagaccaaccgcgccacgggggatacatcattaccctacccctagctagctcaggctacaatggaacaagactgacgtcccatctggctcgccccggaaacaagtaatgatggctccccgcgtgcgtccatgacgacggtggttctcagcctcctacggaagcaaggagacgtcagcaggatcccagcaacgccgacaactgtgcttctacagggctcaggcacttctccgacggccacgttaccgcgtacatagggctctagcacctcttcgacagccacgttggcatgtacacagggctcaagcacctctctgccagacacgttagcgcatagctacacccccattgtacacctggaccctctccttgcatctataaaagggaggtccagggccttcatgcgagggggtcgcgcgggggaacgagctaacgaacaggctcactttctctctctctcgcgaacgcttgtaacccctactacgagcacacccccctggtgcgagataatacgaaagccgcgtttctcccttgtgttccatctcgcgccaacccatctgggcaggggcacgcagcgacaaatttactcgtcggtccagggacccccgggtccgaaacgccgacaataatctaaattatataatccagattataatctagatctattataatctacatgtagttgtttggtagtttagaatatacaaatgtagattattcgtaaagacaacaatacccttatttgtttatttgaggtgagaaaaaaagatggcatatattgtaatttttatttacataatcatgggtagtgggttttttgccaaaataatctcaaataagctattcttgaggagattatgagattagggtttagattatataatctgaacccataatctaggtgtttgtttagctactagattatttgctctggattgtataatctagagagattataatatgaaacaaacagagccataggtcatggcaggccgagccggcccaaaaagtacaggtatagtggcagccttaaaacccctttttcgggcacaaacccccagccgtccgtgacatcgccgggatcccgcccggacctcacccggcgatatgtcgacggcggctcccgcgccgggctccacggccacggtgcgggtatccaacatcccggcctcggccatcgccgcagagctgctcgccttctttgactccgccgtcaccatcgctggcgcgaccttcgcctgcgagatagtcgccgctcaccgcggctggctcagccgcggccacggtttcgtccagtttgattcctccgccgccgccacccacgccatcgacctcgcctcctctggccgcctgccccccttcctcggctcctgcctatccgtctcccccgcccgcgctgacctcctgccccgcgcgcccgacctctccctccgcgctgccagcgcgagcctcattctaggcaaccgcgtcgccgagcgcgagctggaggtggcctactcctgcgacggcgtgcgggccgaggtcatcccgaggatgcggcgtgtggacctctacctgaagcacgattcccagagctacaagcttgaggttctctttgaggacatcaatgagtgctttgggtgccacctcgatgggacgggcgccatcttgctgcaggcgagctgcttttacaccatgctattcgtttcgatgcaaaaagttccaaaacctatgcacccagtgtgactatttcgaattgatagacgacacgcggatatctgattgatatgcactgtcttcaatcctcatttttggtcagccaggagaatgacccctagctcaatctgggtagagttgcaagtcacaagtaaatctatagatatttgcagaccaaagaccaatgacccagctttattggaatcttaagagtagttttactgtggttaccagtttattacaaaagataaggcttcaacaactctactcgagtctgacctttctatgtatagaacacttccaaacaaaccttcgtaagcaacagtcaccgaaagaaccttgactactgtcatcaaaactcgggaaacgaaatgaactaaccccaaatatcaataaaatgtccagcaaagaacagcctaggaggaaaaccactccacggtaaccaccagacacctttataagcatttttcagctcacaactgctctaccccttttgacagttgagggatcatctcctccacatcaacatataattggacctcaattctggcctaacaacccagtagaatgggagcacaatacatttacatacccgagtgggttgcagcctgcagatggagctcccttcttcctctagcgctgcacagaaggatatttttgcaatcttctatggcctgctatagcatatgttgtgtatcagcgttcaaaacaatcacactctaggtttccatatgattcatttattgcataatctagccactttctatttttaataactactcaacaatttgagatatgcacaataaactgaaatcctcataagggataagatcttttactttggaactgatcattaacttcatatttatgcaaacataatcgagtttctgctgaatgttatttgaagtatgtctttttcatcatatttttttgagagtgtaatctgtttaagatttattaacttaatacattgaagtagattttacaaaggatatgctatcaatttcttgtgttaatattatgcttcccctgtcattgttcgtgttaatagtaatctgcccctgctgaatacacattatctgcaacgatatatacttaatgcttgccatatttcattggctgtcaatttatttcagctgcaatattctttgggcacctttttaatgaatctgaagctacactctaataaatagtatcatccttgcttcagctgacttatgcaccaagaatacacattgcaatttctgggtctacagttaaatcaaggtttacagatgatcgctttcatgcatgcaaggaggacgccaaatttgcatgggtcagagcactagatttcacacctaatagctcttttggcgagtgttccactcttgtcctgaaactgagcaaaggtgcatcagtatcatatattcttgaaagtttacccttctcaggagaattaggggaattggccattgcttcgatggatgtgtttggctcctcctccaatgtggttcctcttgttgactgcccaaatggcttttctgtgccttatgaagtactttttcgtctgaactctcttgttcacatggggaagctagttgccaggcatgttaatgctgatctgtttaaagtccttgaagatctgtcaatcgatactttaaggagaatatttgagaaaatgagcaaattaaaatctacctgctatgaacctttgcaattcatcagacatgaggctcatagcatgaatatgagaaagaaagccttgtccaacaagagggagagtggaaaattgatgaggtgttacagaattcacatcacaccatcaaaaatatactgcttggggcctgaggaagaagtttcaaattacgtggttaagtaccattctgagtatgcttctgactttgctcgagttacttttgttgatgaagattggagcaagctttctcccaatgcattgtcagctagaactgaacaaggtttcttttctaaacccttgaaaactggcctgtatcatcgtattctctccattctaaaagaaggattttgcattggccccaaaaaatatgaatttttggccttttcagcaagtcagcttcgtggtaattctgtttggatgtttgcttcaaatagttctctgactgctgagaatataaggaggtggatgggccactttgaagatatccgttcagtctccaagtgtgcagctagaatgggccaactgtttagctcatccaggcaaacatttgaagtctcatcatatgatgtagaagtaattccagatattgaagtcacaactgatggcactaaatacatattttcagatggtatcgggaagatttctactagatttgccagacaagtcgccaaattaattggcttagacccagctcatcctccttctgcttttcaaataaggtatgggggctataaaggagtcatcactattgaccctacatcctttttcaatctttctctgcgacctagtatgaagaagtttgaatcgaagagcactatgctgaacattacaaattggagtaagtctcagccatgttatgtgaaccgtgaaattatctctcttctttcaacattggggataaaggatgaagtatttgaatcgatgcaacaagatgacatgcacgaatcagatggaatgctaacaaataaagaagctgctttgtctgtcctagggaaaattggtggcggtgataccaagacggcagctgatatgcttctgcaaggctatgaaccaagttcagagccttacctattaatgattcttaaagcccatcgggctaataggctgaccgacataagaactcggtgtaagattcatgtccagaaaggccgtgttcttattggttgtttggatgaaacttgcaaattagagtatggccaagtttacatcagaattacaaagaatcacaaggagcagaagtacagtgaacagccgttcttttgcaacgatgatggcaaaacagctgtaattgtaggaaaagttgcaatcacaaaaaacccttgtctccatcctggtgatgtcagagtacttgaagctgtatatgaccctggattggatgctaggggtcttattgattgtgttgtatttcctcagagaggggaaaggtatgttttctattctgaagctgaaaaaaagaccatctcagaatgtggatttcaatttctctgtccatggctgtgaagcaacctgtctactgaattaagacaccgtatttgtccctgttagccatgttgcccatattatgttaatatccaattgtgtagcttacagttagccatttgggttaatgttaatgcttgcactatccttacttgaagccttcaaattaattaggcctcatccgaatgaatgctccgggggcgatttggatggcgacctcttctttattacttgggatgacaaactgattccggagaaggttgatgcacctatggactacactgcaacgaggccacgcataatggaccatgctgttacacttgaggtacactccttactcctgagtgtctctcatccgctcattttttctgaattatgtatactacgtatgatttgctgttcttatttggttaatgtcagatttctgtacttgcaaaatatcagtttatgaattgccgttatctttcccctgagacgatggatacattgatttgtgctgtctactgtattgagctaagaaacctggcgtgtttctaaaatgtgtttatgtaataaggattaaatccatgaaacaggccctgatagggcaataacgagcacaagaccatccagccagcatggtattaagacggtatgtgcattggctggcatgtggaagtaatctacctacttgaaaaatacatgtttaaaatgaaaaaaatgatgttttgaacctgaatatgctcaccgtgagcattcagcaaattcctgcatattttgccatctcgcttgagcaaaaatgttaacatctgcatgcaaatggttgcaggaaattcagaagcacttcgtcagttacatgataaacgataccctcggtgccatctccaccgcccacttgatccacgcagaccgtgatccactgaaagctcgcagccccgagtgcgtccagctggccgctctgcactccatggcggtcgacttcgccaagacgggagctccagccgagatgcccctggcgctgaggccccgggagtttccggacttcatggaacggtgggagaggccaatgtacgtctccaacggcgtcctcggcaagctctaccgcgctgccctgcggcacgaggaggacgcagaagcgctcctgcctgcgggcccaccgagctgcgtgtacgacccggacctcgaggtcgccggtttcgacgagttcctggacgcagcggaggagcggtacgaggcgtacgccgagaggctgggcgccctgatgacctactactcggcggagcgcgaggacgagattctgacaggcaacatccggaacaagctggtgtacctgcggcgggacaacaagcgctacttcgagatgaaggaccgcatcatcgccgccgtcgacgcgctgcacgcggaggtgagggggtggctcagggcgtgcaaggaggacgacgcgtcgagggtggcgtcggcgtggtaccacgtgacctaccacccggaccgccgcggggagaagcggttctggagcttcccgtggatcatctgcgacaccctgctggccatcaaggcggcgcgcaggtgccggaagcgggtggaagacgccgccgtgcccatggactgcgacggttcctagacggaggtgccactgtggcagtgaagtgagcctgtgatgcgagtggaaactgtagtaataagatgcagtaccgctgagcgctgattgctgtaaaaagaagttagcgcgggttgtcttgagctcctcctaacaggcgtacgtatggtggaaccgtggaatcatgatttgccgcccttgctgatgactagaagcaggtacggttagctaagccgttacgt

SEQ ID NO: 696 - DNA, 4654 bp, Zea mays
ttgtcgcttggcttttttcaatcgtgctttcttgattctttcattgcaatcaaactcacttgtaattgaggcaagagacaccaaacttgtggtggtccttgtgggaactttgtgttccaagtgattgagaagagaaagctcactcgatccgtggatcgtttgagagagggaagggttgaaagagacccggcctttgtggcctcctcaacggggagtaggtttgagagaaccgaacctcggtaaaacaaatctccgtgtctcacttgcttatttgcttgggatttgtttttcaccctctctcgcggactcgtttctatattactaacgctaacccggcttgaagttgtgtttatatttgtgaatttcagtttcgccctattcaccccccccctctaggcgactttcagtttcgcagtctgagtttgttacaaagaaacaaactaatactgagaggggctactattgggggccttcgtcttttgaaggtcatcaaaaacacgtttaaccattggtggccaagtattgcaggagcttcgacaccagaataccttcgatacaggacattggaggggcgacgaagctaacttcatcatagcgacacatggagacgatataaagagtcatcatggatgctcaaagcaaaggacaatgtgcccttgtattatttgtaaattctctgtgtaacccttgtgggtgtaaatataatttcgtacaaagctgtacgattctctataaatagatgagcagtgcccttgcataaagtaccttttgaaggctcggacaattgctgtgtgtaatcttttctctaaagcacattcactttaattcattctctagagtcgaaggtacgatcgtaaattcattatacgaaagaggaaatatgatattgatacatctgagatgagtcgttatgttaaaattcttttacattcttcacctatttatgcaattaagtcatgacttattcggacagcttaatgatgaaggttgatcatctttctaatattgtgttgccttattgattgtacataccaatcgggaacaagtgaccaacagctgcgactgttacgctaacaaccaacgaggaggagacgatcatgatcctctaatttctcttcatcgatgcgtgcccatgttagatcggcgctccaactagtcttccactgtactgcgtgtaatggtaacgattcatgatttcttaagatttgtatgtaatgtgatagatatgtcgagcaccgtagcacgtttcctaacacaggcatcaatacaatcaaacttttcatcctctttttgctggatgcctatactttcttcagcgaaaaaagataaatgactggataaaaagagagaggccactgaccgaccaaccccaaccacatgcaacacacacttcgcatttgcatccatccctcgctcggttatgaaattttttaaaccccttccgatcctaaataaaacggaaatcaaccccacaaaacccctgcgtaaagagacccaattgctatctcctccagcatccacccaacggatccgcggcaaccgaccacccatgggatcgctccggggcgcggcagcctcctccgcggcgccgcgcgcgggcgacctggtgaccacgcaggttagccttggtggatttgatgccaccgtcaaggcgctcgatctcgccgacttcctcgagttgaatgcgggctcggtctggcgctgccgcctcaagacctcctggactccgccggacgcctatcccgacttccttctccccaccgtcacctccgccgccgcgccgccgccacagtacgatcgcgtgcctccgcacgccttcgtccactttgcgcgcccggagggcgcgcgcgccgccgccgacgcagcgggccgatccgagctcatcctctccggcaaacccctgcgcgccgcctccgcacaggacagctcccttcgggcatcccgccgccgtagtgtctcgccattccgcttccctggctcgcgcctcgaggtcggggatctcccggcctcggacgccttcatcgccgcctggcgcggcccggcctctgggctcgagttctccgtcgacccgttcgacgggtcttgccacttcatcttcgcccgcgacaccgctttcaaagtccgggagttccgcgagtctgtggtgatgcgctgcgacgtcaagctccagttccccgtccgcgatgttgcggaagtcagggtgttccggctcgactgctcgctgctgatccggctatcggccgcaccgctggtctgttaccgcacggcggatgacgacatccacgtgtccgtgccgttcgacctgctcgacgacgatgacccgtggatacggaccacggacatcactccaagtggtgcgattgggcggtgcggtgcgtatagaatcacattctcgccgcggttctggccaaagatggaacgcgcgctgacgtacatgagggataggagggtggcgatccttgattgcgttggagggtggggggccaggagggggctcaccgtgcgtgatgagcctgagtttggggagcggatgcaggacctgttcttctgcgtgcagcacgccgagggtctcaagtttccggtgttgttcctcgtgaatgctctggtgcacaagggagtaataagtcaacaccacctcacgcctgaattcttcggtttgctccagaggaaggaggatgatgtgaatgtggctgccttgagggaattttggggggacaaatttccagtttttgatgcatgtgggaggctgaagaatctgcaggatagggttgccaggtacctgaaacatcttcgcaacaagattggggatgtcaattctgaggtgaggaggctggtaatcacgcccaccaaggcttattgcatgccaccagaagtggagcgctctaatcgcgtcatccggcattatagtgaagtctcagaccggtttctgagggttacttttatggatgagagaatgcagatgctcaacagtaatgtgctgaatttctctgctgcacaaatcgtcaaagatttgatgtcaaactcgttcctgcataagacaacagtgtacaagcgtgttaaaacgtttttgacagagggattccacatgtgtggcaggaagtactcgtttcttgcattctcatctaaccagctgagggacaggtcagcatggttcttcgcagaggacagaacgacaacagtggaaaccattaggaaatggatggggcggttcacaagtaagaatgtagcaaagcatgccgctcggatggggcagtgcttctcctctacatatgctacggtggtgctgcagccgcatgaggtaaatgagtgtcttgatgaagttgaacataacgggtacattttctctgatggaattggcaagattacgtgcgaccttgcactcgaagttgctcagaagctgcaattgacagataatcccccatctgcttaccagattaggtatgcaggcttcaagggtgttatatctgtctgggaaggaaaaaatgatgggatacgactttccctgaggccgagcatgcacaagtttgagtctaaccatactgtgttagaggtggtctcgtggacaaagtttcagccaggattcttaaatcgtcagattattacattactgtcctccttgaatgtcccggatgctatctttgctcaaatgcaggaagccatgttatctaatctcaacaatattttgtcagactctgatgttgcttttgacattgtaaccgcctcttgtgctgagcaaggaaccactgcagcactgatgttgagtgctggcatttcacctggaactgagccacacctgaaagcaatgctgttagctataaggtcctcacagctgctaggtcttttggagaagacaaggatttttgtgcccaagggaaggtggttgatgggctgccttgatgaacttgggatccttgagcaagggcagtgctttatccgggcatcatctccatcactcaataattgtctggtgaagtatggatcaagattgtctgcagcaaacacaaatgcagagaccattctgggtactatcgtaatggcaaagaatccatgccttcatccaggggatgtccgaatccttgaagctgttgatgtgcctgaactgcatcaccttgttgattgcttggtcttccccaagaaaggtgagaggccgcacgcgaatgaagcatctgggagtgatcttgatggggatctatacttcgtaacatgggatgaaaaccttataccacctggtaaaaagagttggaaccctatggactactccccagctgaagcaaaacaactgccacgcgcagtatcccaacatgtgagtccaactattcttggaatttcttcccttgaaagttcaatatatgtatgcattccctcaaacattagtttaatgttatgatgccatcccattactaaattctgcttgacagttagtgtttttactgagcaaactctgctgtagctaatattgaagttgagcatatagttccatggaatttgtatcataggttcaactctgaatcagggattgtatttcttcctagttcctactaattccatacctgttaattaacttaattggcatgtcacatgtgaaatcctatagttttggactatgtctttatatggttatatcgtcttctactccctccagtctggtttctaa

SEQ ID NO: 697 - DNA, 39810 bp, Zea mays
  misc_feature (9316)..(9415): n is a, c, g, or t
  misc_feature (11675)..(11774): n is a, c, g, or t
  misc_feature (14383)..(14482): n is a, c, g, or t
  misc_feature (29335)..(29434): n is a, c, g, or t
taaagcgctagcaggtagctaaccatagtaacccaaaaggtaaatcaaagacagggtaaatagaaagctagtaaatccttaggttgttcatagtatgcgggacaatgtattataaagtaaatgggacataatgggtcagaggacacttgccttcaccaaaacatatgctcagggtcttcaacttcgtggaacccaaagagctagatcacttggtcgccgaagcttgaccgtcgattcctcgaagttcggaaacgaatcgcgatccaatcgcaacgcgaagcgaagacaaacagacacaagcaaacaaacatatatatgcataagaacattacaccatacaagataaaatgttataaaagcgagcaatataaaatagagagcgcttctacggttacgcgagaaaaagaaccatgatagacgaagctatggtcgaggggttagcacgtttacgttaaacaagtactaattagaacatctaattcaacataattatattaattgatattaatcaaatataaattaatactactacttagttttgactaacttactattttaatagttgacagttaagcaagtaacttaatgaatatgagcgattctaagcgagacgaattaaggacgcacgacgtgcaaacacgatgtgcgcaacgcgcggacacaaacgacttagtgcgcggacaacgcgcgatacgcgcgaacggcacgcggcaaggcgcgtgacacacgcgaacggcacacgacaacgcgtgcgaacgacacgcgcgacactcgcgaacgacacgcgacaacacgcacggaccgacctgcgaaactaataaataaacaacgtgattaaactaaataattattaataaataacatttcagttaaggttaatcatattgatgactaattataaatgcgcaaatcgaaatcctaaattaggtttttaaattgaaacgtcgttctagtagccactggttaaacaaacgtctaactaaattaaataaaatgtacaaaaattgggataaatatatctaaattaagataattttaatacgaatctaacgcaacttgaatggatcgaatcgggtttaaaacgcaaaagttataaatgttttaaatcatactgtaattcgcgcggactaaatttacgagactgccatcgtcttcttcctctcctcatcttcttcctcccatccatggaagagagaggaggggaagggggctgcgcaggggaggacgagaccgggccggccgggggcgggcgcggccgcacctggcgcgcggggcgcggccacagccgctggggaggggtgcgcgcgggcgcgggagcacgggacgcgggcgccaccgccggccaccgccgccgccgccggggagggagaaaggggcgccgtcgaggaggggaaaacggaggggggaggggcgccgccaccggggaaggtgaggggagagtgggagaggctctgcaccggacgggaaaacgaagaaaccgaagaaaccctaggtgcaacaatggaggtttctcaccggggaagaagaccctcgccggagccgaggagaaatccgtcgattgccggagatttggggatccaatcgatgaaccgaacgcgctgcgacgaagccttcgacgagacgaacgcagcggtaccctcggattccgcagacgatgcacggattgggagtaattgctcgctggagttagaaccgcctcgaacttcagcgagcaataccgggagctagggattggatttgggggaaacgtttggtgttctggaacgggctcgacgagatgaagccggacatgtatatatacctagggtttggacgagataaaaattcagttaaaattcggattttactatttttaaaattcgaaaaagcctagaaatccatattttgtgctcaaaatattatagatactttcaaaaattccagaaaaattcctataaatgttttgggacctaatgaactcaaaaaacataattagaatttctaaaaacatttttaagttccacaaataaatagattttggtttccggaaaatagaaaaatattccgaaaaatatgaaaatttaccgagcgcttctataagatatgttaacatgtttcaaacacattttgcacttagaaacaccatgcaacggcatgaatgcaacaaccaaagtgcctctagggctcattccactaggtttacgctaatataaaacaaaatgattctccatttttagggaaaagagaaaggaaagcgaagaactgagagagtaacaccagaatttggtggatattagaaaagaaattttataccctcaaattcagggtgttacaaaaggagacttccaggagttccaagactacgacgagttctaggtgtgggttagcggcaacccccagtcggctgcctgtgaaggccgcggttatctacgtttcttttccgcactttgatttattgtaagaactatatggacgtctcagacgtatgatgtaatcaactattattcccttttaatactattttgagcactgtgtgatgatgtccatgttatgtaactgctgtgtacgtgaataactgatcctgacacgtacatggttcgcattcggtttgccttctaaaaccgggtgtgacataagtggtatcaaagtcgtgctgactgtaggaccgctaacctagagtagaatggtcgttctaaggactatagacctttgtcccctccttgactttgatatcccttcaaaagttggtcataccgaccaaacctatgttctactatatattataccttgctgaaaatcatgttttattctaatccttcatttacttatgattcatttttgctggtcatattaattctgttctcacccttttgcttgcgatgtcttttatagatggctcgacttagacacactgcacgaaagtccgtcatccccttcttaccctcccgccttgctgagcgtccgcttcgccgtcccgtggccggacagtccagccacttggagagactgcaccaccgcctgcatgaggagcaggaacgtcgacgacaggagcaggagcagcagggctcttccttctcgctccaccaggagatagagtctgtgaggagctgctcccctgtgcttcctctggaggcgccccctgcaccaccactgggcgtcccagcttctggagtagctgctggaggagatccagacgacggagatggcgacgacagctcgagccacgacaccgacttctctgctaaccatgagctggaaggatggtttgctcgatccatcactcgcgacgctgctcgcgggtgccacttccacgatgcgctcgataccctgctacatcgggcacttaaccggcatacttggtccatcgagtatcgctgtgtggtctaccagcactatcgcggggtctacccagaccgctgggaggcaacttgcttggtgcgccgtccggagaacagtctccagggtgcagaggcctgctcagagcactattctatctctgagcgggactcagctgaggcagccatgcaagatgctgcacgacgtgcgctttcgcactactgctcggttttcggtggggtagctgacggtcttgacctgaggtattacccccgccgttcatctggcagcacaggaggcgtgattgtctcacctgtccgtgagggcaatcctaggttgagcagcacagtcaacctagccgccgtgctaaacacggagctggaccatgcattggacgagctgagtagggctcgtgctgagatcgcccagctgcgggctgagcgcgcggaacgtcgtcacctggaggatggttcccccgctcccgtcgggactcagcacctgtaccgttcacctcggcgtggatcccagtcttatggcaatcccgactgcaagaccaagataactctagaaccatagatcgttagagttggatcttgtaattaatacaaaatatatacatagaagcttcagtcttagcgttagtctcagttttagttagtcttagttagacatggtagtttgctatatcctgtgcatttatgtttgtcatgatgaactatgtttggtttggatctttgtaatgattgtcaccagagtgtgggtatcccctgcattttggtttacctattatgataatggagttagttatatagttgggaaaccttttattccactttcctctttatctgagaagctgtgtggtctgtgttggagatcagtgaagatgctcatctgttcagtgctgttgaagaatcctctactcttttcttatgctgcaagatttgtcagatcagttctgatgtgtggttgcattctgcagatgtcagagaacaggcgcagaggaggaaggcgtgctcagcaggagcgagccgctcaacaggatgaggtgccccagcagcagcacctgccgcccccgcccccgatgtccatcgagcagatgtttctgatgcagactcaggcagttcaagccatcggtcagactttggccgccattcagcagcagcagcagcaacagcagcaggccccacctcagcctcagatgcctcagatgcccagagacaagcgtgctgaatttatgagaggtcatccaccaacgttcgctcattcttctgaccccatggatgctgaagactggctgcgcactgtggagcgggagttgcataccgctcagtgcgatgacagggagaaagtcttgtatggtccccgtcagttgagaggagcagcccaatcatggtgggagtcttacctcgccacccatgcccaccctgacgccatcacttgggaagagttcagaggtagctttcgtcagtaccatgtccctgcaggtctgatgacagtgaagaaggaggagttcctggctctcaagcaagggccgttgtctgtcagtgagtatcgagacaggtttctgcaattgtctcgctatgctcctgaagatgtcaacactgacgccaagcgacagtaccgtttcctgagaggcttgattgaccctcttcagtatcagctgatgaatcacaccttcccaacattccagcacctgattgacagagcaatcatgacagagaggaagcgtaaggagatggaggatcgtaagcgcaagatcagtggaccccagcctggaagcagtaatcgtcctcgtttctcaggcaatcaacctcagcagttcaggcagaaccagcgtccacctcagcagcatcagcagttccaaaggcagtatcctcagcatcagtaccagaaccgtcagagcaatcagtcaggaggtcagtttcagaagcagaatcagcaggcacctcgtcttcctgccccagcaaaccagcagagcagtcaggcagcaccagctcaggttgggaacagggcatgtttccactgtggagagcaaggccactgggtgatgcaatgtccgaagaaggcagcctagcagcagtcaggccccaatgccccagccaagcagaatgtgtctcagcctggagcaggcaatcgctctcagccgcgctataatcatggaaggctgaatcacttggaggccgaagcagttcaggagacccccggcatgatagtaggtatgttcccagtcgactcccatattgcagaagtgttatttgatactggagcaacgcattctttcattactgcatcatgggtagaagcacataatcttccaattactaccatgtcaacccccattcaaattgactcagccggtggtagaattcgagccgatagcatttgtttgaatataagtgtggaaataaaggggatagcgtttcccgccaaccttatagtaatgggtactcagggaatagatgtcatcctagggatgaattggctagataagtatcaggcagatatcagttgtgataaaaggacaatcaagttggtgtctccactaggagaggaagtggtgaccgagttagtcccgcctgagccaaagaaaggaagttgttatcagatagccgttgatagcagtgaagcaggcccaattgagagtatcaaggttgtgtctgagttcccagatgtgtttccaaaggacttaccaggtatgccaccagagcggaaagttgagtttgccatagagcttcttcctggaaccgcccctatctctaacagagcttacagaatatctggaccagagttggttgagcttaagaagcaaattgatgagctgtcagagaaaggttacgtccggccaagcacctcgccttgggccgctcctgtcttgtttgtggaaaagaaagatggcaccaaaaggatgtgtatcgattaccgagctttgaatgaagtcacgatcaagaacaagtatcccttgcccagaatagaagatctgttcgaccagttgagaggagccagtgtgttctccaagattgatctgaggtcaggttatcatcagctcaggatccgaccttcggacattccgaagatggcattcatcaccaagtatggtttgtatgagttcacagtgatgtcttttggtttgaccaatgcgccagcgttcttcatgaacttgatgaacagtgtattcatggattatcttgataagtttgtggtggtattcattgatgacattctgatttattctcaaagcgaagaagagcatgcagatcatttgaggatggtattgcagagattgcgagagcaccagttgtatgcaaatttgagcaagtgtgagttctggatcaatgaagtcctgttcttgggtcatataatcaacaaagaaggtttggctgtggatccgaagaaagtggcagacattctgaactggaaagcgccaacagatgctcgaggaatcaagagtttcattggaatggccggatattatcggcgattcattgaagggttttcgaagattgcgaaacctatgacagcgttgctaggcaacaaggttgagttcaagtggaccagaaatgccaagaggcctttgaagcgctgaaagagaagttgactacagcgcctgtcctagtcttgcctgatgtgcacaagcccttctcggtgtattgtgatgcttgctacacaggtttgggatgtgtgttgatgcaagagggaagagttgtggcttactcgtcccgacagctgaaggttcatgagaagaattacccaatccatgatctagagttggcatcagtggttcacgcactgaagacatggaggcactatctgtatggacagaaatgcgatgtttacacagatcacaagagtctgaagtacatattcactcagtcagagttgaacatgaggcaacgaagatggttagagttgatcaaagactatgagttggagattcattaccatccaggcaaagcaaacgtagtggcagatgctttgagcagaaagagtcaagtcaatctgatggtcgctcgtccgatgccttatgagttggccaaggagttcgacaggttgagtctcggatttctgaacaattcgcgaggagtcacagttgagttggaacctaccctggagcgcgaaattaaagaagcgcagaagaatgatgagaagatcagtgagatccggcgactgattctagatggcagaggcaaagattttcgagaagatgcagaaggtgtgatatggttcaaagaccgtttgtgtgttcccaatgtccagtccattcgggagttgattctcaaggaagctcatgagacagcttattcaattcaccctggcagtgagaagatgtatcaggatctgaaaaagaaattctggtggtacggaatgaagagggaaatcgcagagcatgtggctatgtgcgatagttgtcgaagaattaaggcagagcaccagagacctgctggattgttgcaaccgttgcagatccctcagtggaaatgggacgaaatcggtatggatttcatagtcggattgcctcgcactcgagccggctacgattccatttgggtagtagtggaccgcttgaccaagtcagcccacttcataccagtcaagaccaactatagcagtgccgtattggcagagttgtatatgtctcggatcgtttgtcttcatggtgtgccaaagaagatagtatcagatagaggaacgcagttcacctctcatttctggcagcagttgcatgaagccttgggcacgcatctgaatttcagttcagcttatcacccgcagacagatggccagaccgaaaggaccaaccaaattcttgaagacatgttgagagcttgtgcgttgcaagatcagtccggatgggataagcgattgccctatgcagagttttcctataacaacagttaccagaccagtttgaagatgtcaccatttcaggcgctctatggaaggagttgtagaactccgttgcaatgggatcagcctggagaaaagcaggtgtttgggccagacattttgcttgaagccaaagagaacatcaagatggtccgagagaatctgaagatagcgcaatcgaggcagcgaagctatgcagacacaagaagaagagagctgagttttgaagtcggagactttgtctatctgaaagtgtcaccgatcagaggagtcagaagattcggagtgaaaggcaagttagcaccccgctacattggtccgtatcagattcttgcaagacgtggagaagtggcctatcagctcagtttgccagagaatttgtctgctgtgcatgatgtctttcatgtgtctcagttgaagaagtgcttgcgtgtgccagaagagcagttgccagtggaaggtcttgaagtccaggaggacttgacctacgttgagaagccagtgcaaatccttgaggttgcagacagagtcacccgaaggaagaccatcaggatgtgcaaggtcagatggaatcgccactcagaggaagaagcaacctgggagcgtgaagatgatctgatggctaaataccctgagctctttgctggccaaccctgaatctcgagggcgggattcttttaagggggataggtttgtaacgccctgaatttgggggtagaattttttcttcttttctctcaccaaattcaggcgttactcttttcttttctcgttctctcgctaagccttgaccttttccgaagttttagcggggttcggcttggaattcccgtgttaagaaaaaccctaaattactttatgttgtttgatgcaccatgccgaactatgcattctttgattgcttaggaatgtaagtgcattcatctaagaagatcagatttcgaaaagacgaaaaaccttttctttctttttctttttctttctctccctcctccttttctctcccccgcgccgtgggccgccccggccggcccagtcgcccccgcccgtgcccccttttgggcccagttggcccagccgcccctccctcttttccccaaaacccctccctctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaatactagcagccaagaaaaaaaatagtaaaaaaaactcataaccaacacgataacaagccatccaagtccaaccaacagcatccccatcacgaacgtcggcggactgccggacgccgtccgccgggacacaacttagccgaggagtggccgacgggcccggcgacgcgggcgatcctgaccggcttcgacgccggcctctcggcgcgtggcctcgccgacgagttggagcgcttggcaggcaccgtctggcgctgcaggatcaagacttccgtcacgccgcccgagtcctacccggacttccagctctcagtccacgccgccgccgccgccgccgtgttccaccaggacgagccgccgcgggacggtcgcgtggcccctcatgccttcgtccacttcgagcaccgcaatgccgcggaccgcgctggcgacttcttcacgacgcgcatcctcgcgcagagcagacacatgctacatggccatgcggcgcgccggcgggatggtgtcaccgacgccgccaaaccgatgctcttccccaactcgtgcatcgagatcggcgacgtcgtggcgccggacaccttcctcgtcgcgtggcgcgggaccgacgacagcgcctcggcgctcgacttcgtggtggacccgtctggcggcagctgccggctgctgttcgcccgctacaccgccttcacgtgccccgacaggcgccggcccgcggcgctgctgtgctgcgacgtgaagctcgagttcgcgctcgcccacgtcgccgaggccctggcgttccaggccgacgactcgctggtcctccggctctccgccgcgcccctcgtgtactaccgcacgtcgggcgacgacgtccacggccgcgtgcccttccaactcgtcgacgccgacgacgacccgtggatacggaccaccgacgtgacccggagcggcgccatcggccggtgcttggcgtacagggtctccttcgcggtgcagttctggccgacgatgagggtcgcgctggagtgcatgcagaggcagggggtccccgtccacgtacgcgacagacggtgccggggcttcaccgtgctcgaggaggcaggcttggtgcagccgatgcgggacgcgttcttctccccgcggcacgacgacgacgcaggggcagggctacggttcccggtgctgtacttggtcaacgtgctgatgcacaacggggtagtcaatccgcaccagatgacaccggagttcttcggtttgctgatgaggacacgcgaagatgtgaacgttgctgcgctgacggaactgttcggtgcaaagcttggagtctgtgataatccatgctggaggttgaagaacgcgcaggacagggctgccaagaatctcgatcttgtctgtcgcagcagaagaagaaaggctagtgattgcgatgctgaggtgcgaaggctgatcgtcactccaagtctccaaccagggaatactgtatgccggtggagcgctccaaccgcgtcatccggcattaccacgagctgtcagatcgcttcttgagggttacttttacggacgagggtatgctgccgctgaaccctaacgcgctgaccctccgtgcggtgccctcgacgtcgacgcccagcacatcccggcagatgacaagcgtctacaggcgtgtccagacggccctgacggaggggctcatcatgtgtggcaggaggtactcgttcctcgcgttctcagccagccagctgaagcagaagtcggcctggttcttcgcggaggacggagcgacaacggtggcaggcataaaggagtggatggggcagttcccgatcaggaaccccgcgaagcacgccgctcggatggggctgtgcttcacgtcttcctacgcgacggtgacgatgcagcccggcgaggtggacgaggacctcgaggacgttacgcgcaacgggtacaacttctccgacgggatcggggtgatcacggaggacctcgcgctggaggtcgccgagatgctgccgctggcggacaggttcgccccgtccgcgtaccagatcaggtacgcggggttcaagggcgtcgtggctgtctggccgccggggccgggacaagaagaccgtgggacgcggaggatgtcgcttcggcccagcatgaggaagttccagtccacgcacaccgtgctggaagtggtgtcctggaccaagttccaaccagcgttcttgaaccgccagatcataacgctgctcaccacccaaggcggactcgacgccggcccgcactgccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactgcctttccgaacagttccgatggtaaccgtagcctcaacagaagaggactgcggcccaagccgcgaaatgtttccacggacgatctagggggtacctccgaaggcatccatctcggcatgcccgaaaggacggtgatctccctaggacggtgcctcgcgttgacatcccacgggagctagctgtggttccccgttcaggcagggggacatgacccacagctcgagcaagtccgcggggtgcaggccatgctcgacgagggagcaggagcacttgagccgatccgccgggacgtcgggcaggcatgggcgggcccaacccccggccggagaaatacgtcatctaccccagggctttcagcaccgcatcgccgacgatgtcagggtcaggccgccacccgcatccagtggggtcggctagaacctggctgcagcagcaatgctcctccgcgcgatgccggagccatcaaccaccgagggacggcgaatccagggagagctcaagaatctcctggaaggcgtcgcggtccgacgggccgagagcaccatcaccgcgaccgtcgggcccacctcgacgagagggtgcgtcggggctaccaccccaggcgtgggggacgcaacgacagtggggaggatcggagtccttcgcccgaaccacccggtccgcaggccttcagccgggccatacgacgggcgccgttcccgacccggttccgacccccgactactatcacaaagtactcgggggagacgagaccggatttgtggctcgcggactaccgtctggcctgccaactgggtggaacggacgatgacaacctcatcatccgcaacctccccctgttcctctccgacaccgctcgcgcctggttggagcacctgcctccggggaagatctccaactgggacgacctagtccaagctttcgccagcaatttccagggcacgtacgtgcgccccgggaattcctgggacctccgaagctgccgacagcagccgggagagtctctccgggactacatccgacgattctcgaagcagcgcaccgagctgcccaacattaccgactcggatgtcatcggcgcgttcctcgctggcaccacctgccgcgacctggtgagcaagctgggtcgcaagacccccaccagggcgagcgagctgatggacatcgccaccaagttcgcctccggccaggaggcggtcgaggctatcttccgaaaggacaagcaaccccagggccgcccatcggaagatgcccctgaggcgtcgactcagcgcggcgccaagaagaagggcaagaagaagtcgcaagcgaaacgcgacgccgccgccgcggaccttgtcgccgccgccgagtacaagaaccctcggaaaccccccggaggtgccaacctcttcgacaagatgctcaaggagccgtgcccctatcaccaggggcccgtcaagcacacccttgaggagtgtgtcatgcttcggtgccacttccacagggccgggctacccgcggagggtggcagggcccacgacgacgacaagaaggaagatcactaggcaggagagttctccgaggtccgcgactgctttatgatctacggtgggcaagcggcgaacgcctcggctcggcaccgcaagcaagagcgccgggaggtctgttcggtgaaggtggcggcgccagtctacctagactggtccgacaagcccatcaccttcgaccgagctgaccaccccgaccatgtgccgagcccggggaaatacccgctcgtcgtcgaccccgtcatcggcgacgtcaggctcaccaaggtcctcatggacggaggcagcagcctcaacatcatctacgccgagaccctcgggctcctgcatgtcgatctgtcctcggtccgggcaggcgctgcgccctttcatgggatcattcccgggaagcgcgtccagcctctcggacaactcgaccttcccgtctgcttcggaacaccctccaacttccgaagggagaccctgacgttcgaggtggtcgggttccgaggaacctaccacgcggtactggggaggccatgctacgcgaagttcatggccgtccccaactacacctacctgaagctcaagatgtcgggccccaacagggtcatcaccgtcggccccacgtacaaacacgcgttcgaatgcgacgtggagtgcgtggagtacgccgaggccctcgccgagtccgaggccctcatcgccgacctggagagcctctctaaggaggtgccagatgtgaagcgccatgccggcaactttgagccagcggagacggttaaggccgtcaccctcgacctcagcggcgatgcctccaagcagatccagatcggctccgggctcaatcccaaataggaagcagtgctcgtcgactttctccgcgcgaacgccgacgtcctcgcgcgaagtccctcggacattcccggcataccgagggatgccgccgggcactcgctggacatccgagccggagcccgacccgtcaagcagcctctgcgccgatctgacgaggagaagcgcagacccttaggcgaggagatccgcaagctaatggcggcagggtcatcaaagagacgaatctctagaatcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccccccctgttttttttatttttttattttattttattttatttcagtttatgtcctattatttattttattttaggcaggttaatcattgttcatgttattgaaataggaaacttaatttagaattccgttacgctagttaattcatataatcaattgtttatccagttcaatgttgatcaactaaaaatgactaggtttccattagtgcatataactaaattcttttgttagaaccaattgtaactaatcgttagtgcataagctttaacccctgcgagactttttcccgtttctttctaaccataatgaatgcgatatcgaatgtcatacttgatgcatattcactttatttgttcccttgtatgatgtactgtttgtttcccaatttgaatggatgaatgtatgtatgcttgcaatcgcatagagaacgatccggtcgaagagcccgaggaactcgcaggagaagcccctgagcagcagtcggttggtggaggcaagtgtcctttgacctatctctgtcctattcattctttaattcacctcccgctttacacatttatacctaaggattgactagcttttgttatccatgtccttgattacctatttgggttggattattattacctagctttatgctattgcttaactctaattaatgaacatgatgagattatctatgatacgctgttttcccttctcttattatgatgttgtacttgtgatcttcaagggggctcgagcggtttctcgagtgcctctccgtaaggacctgttctatggatgaccgcccgggaaaacagtgcaaccatgagggtagaatggggtgcccttagctgaataattagaggatccgggatgtagttcacttagctgtcgtgccgtcaatggggctcggtgtatgcggctcgctctgccaaggttgatttgtcccttggggaggagtgcggtacatttaggaaacctaacgggtggctacagccccggggaatctttgtaaaggctacgtagtgatgccctgctaggccacctaggtagtggtcaatggggagtagctctctccgggcagaaagggaatcacgacttgtgggtaaagtgcacaacctctgcagagtgtttgaaaactgatatattagccgtgctcgcggttatgagcggccaagggagctccagtgattagtggtacttgatcagagacattgtggtacaggtggctatgagatcgatggtttggttatggctatggtgctggtaagtggtattctttccgtttggaaagggtacatcgggttaataacttgggtaatgctaaaacttggctttctactagtaagtaataatctgaccaactaaaagcaactgcttgacttatccccacataaagctagtccactacagccaaacatgatacttgctgagtatgttgatgtgtactcacccttgctctacacaccaaacccccccaggttgtcagcattgcaaccactgctcaggcgaagatgaagctgtggaaggagacttccaggagttccaagactacgacgagttctaggtgtgggttagcggcaacccccagtcggctgcctgtgaaggccgcggttatctacgtttcttttccgcactttgatttattgtaagaactatatggacgtctcagacgtatgatgtaatcaactattattcccttttaatactattttgagcactgtgtgatgatgtccatgttatgtaactgctgtgtacgtgaataactgatcctggcacgtacatggttcgcattcggtttgccttctaaaaccgggtgtgacatacaacctctctagagtgtaaaactggtatactatccgagctcacggtcatgagcagcttaggactctcgcatgattaaattatggaactaaaattcaatttgtcatatacattgcatgggattatttattaattttgttttattattcttattatggtttgatatttacttacatttagtaacttctaataaaatttgaccaatttaataaaagcaatgcttagctttaacccctattgttgatcagtcttacacatcacatgaactcccacctttggtgagtttatgcacattattccccacaacttattgagagatgaacatgtgtgagctcacccttgctgtctcacacccccacgggagaagaacatgtggttcaagaggagccacacaacgaggagtttgacttgatctaggtgacgtctcccagttgactttatggcgccaaggatggactttagtgcattttatatttattttttattttgtaagacttccgcaatgtaataagtactctaatgttattgtgacatttatctctatacactctgttattatatgtgttgtcttctttggcgcctatatgagatgcacccggctttgtcccttaaatccggttgtgacatgctgggcaaatcctgatgaaaagacctggtgttttggtgcctgaggacattgttgctgacattcttgttgtgaccgctggtgtgaggaaaccttcttcctctgttaatcctgctggtgaggtcccctgcaagaatgctcctccacggtaatttgcgtgatgaagacatactttggataagaaacacttttcattgagttagtatttttatcaagacgttgtatcatagtgttcatgcgtgcgtggccacgctatgttggcttaagccgaatgttctgtcaggagggtgttgagatcgccctcatatatacgagtgtgagcatgctgtattgccctaaggcattcctgacttaagctgattgctttgttagtagggtataatagtcaccctaagtcatgtaagtgtgagcatgtcgcaccgacttaaggcgtttctgacttaagccaattgctccgttagtagggtatagtagtcaccctaagtcgtgtaagcgtgatcatgtcgcaccgacttaaggcgtttctgacttaagtcgattgctccgttggtagggtatagtagtcaccctaagtcatgtaagcgtgagcatgtcacaccgacttaaagcatttccgacttaagtcgattgctccgttggtaggatatagtgatcaccctgagtcatgtaagcgtgagcatgtcgcactgatttaaggcgtttctgacttaagtcgattgctcagttggtagggtatagtagtcatcctaagtcatgtaagcgtgagcatgtcgcactgacttaaggcgtttccgacttaagtcgatttctccgttagtggggtatagtgaccaccttgtgtcatgtaagtgtgaaggtatgttgcgtcggttttaagtcgtatccgactcagaccagttgttgatctaaaatttgtatgcagtagaacatagaagctttattgataatgagaccttttgcttacaaagtacaacttgtccaccagagttttgaggtactgctatggatagaatttcctgaggtgctcaatgttccatgaaatcttcacttcggtgccatccatttgggtgagtcggtaggatcctgatcgggtaacttctgcaacgatgtatggtccttcccatgggggtgacagtttgtgccgtccttctcccgttagtactcggtggaggagtaggtctcccattgcgaaggatcgatgtcacactgctttgtcgtggtagcgcctcaaggtttgctggtatctggttgactgaatgaccacattcagccattcttcatctaatatatcaatgtcttccagccgggttgcttatgccttagctatgtttttgaatgttagcctaggcgctccaaagatcaaatctactggtagtattgcctctgatccatataccatgaagaatggggtgtttccatgtaaagcccagcttgactgtgttcgcaggctccagaccacgtacggtagttctctgatccattttcctgtaagcttttcgctcttgtcgaacaccttcttcctgagtgctccaagtatcattctgttggctctttccacctgcccattagctcttgggtgtgccactgatgcatacttgatctggatgctcctttgctcacaaaaatcaaagaactatgagctagtgaagttagatctcaggtctgtgatgatgctgtaaggtgtcccgaaaatctgaacattatttcctgaatgaattccaccgcctttgctgaggtcaaagaggcaacaagcttgtattctatccattttgtgaatttatcaatggcgaccagtatgtgagtgtatcccccttgagcttttttgaagggccgatcatgtccagcccgcagcatgcgaaaggccaggtcacaggaatagtctgcaactattgggctggtaagggttgctgctttgataagaattggcatacttcgcacttctgaaccaactttgctgcatcattcttcgttgttggccagtagaacccagacctgaaagttttccctactaatgtccttgatgctgcatgcacgccacattgccccgcatagatttcatccagcagctgccttccagtagtcgagtgaacacacttcatgaggactccttctgcccctcttctatatagtagaccccctatgatgatatagtgggccgactgtcccgcgatgcgttctgttgtggctttatcatctgtttcttccttgttttttatgtatctgataattagttccctccagtcgttgggatctgcttctgtctgacccagaacgtggcactcctcaacctgctcggtggtgacgcttggctgttgtatctcttggacgaaaaccccaggtggaacttgggcccgactagaccccagctttgacgcttggctgctgtatctcttgatgcgttgcgacccctttctacatgatggaattctaaaccctcgaatttgtcctccaccttccgtactgctgcgtagtatctattcattgagtcgattgagcagtcccagtctttgtttacctggctgatgaccaccagtgaatcgccgtataccattaatcttttgatgccgagtgagatggcgatgctcagcccatgaaccagggcctcgtactctgcagcattgttggacgctggaaacaggagctgaagcgcatacttgagttgatcacctccaggagcgaggaaaagaatccctgccccggctccctgcaatcttagcgagccatcaaagtacatttttcagacttcagcagcttctgggtttttcggaacctggtgctcagtctattctgatacgaaatcaactagtgcttgagtctttattgcagtgcgaggccggaattctatatcatgagctccgagttcgcatgcccacttggttgttctcccaacaacttccttgttgtggagtatatctcctattgagaatcctgtgactattatgactatgtggtcgtcaaagtagtgtcgaagcttgcgagcagttagaagttgaaagggaattaggcttacacctagctcctaaataattttggtggttgaattgcccaacacaaatctttggactaactagtttgctatagtgtataagtaatacaggtgccaaaggttcacacttagccaataaaaagaccaagtgttgggttcaacaaaagagcaaaggagcaaccgaaggctcctctggtctggcgcaccggactgtccggtgtgccaccggacagtgtccggtgcaccagaggaattcaactcaactcgtcgccctcgggaaattccagagcccgcgcgctaaaattcaccggactgtccggtgtacaccggacagtgtccggtgctcatttgagacgtggctcaggaactcgccagtctcgggaactcgcgaaggctgctccgctataattcaccggacatgtccggtgtgcaccggactgtccggtgcaacctcggggcaacggctacttcgcgccaacggtcacatgcaggcgcatttaatgcgcgccagaagcgcgcagtcgtcaggcacgcgggagcaggcgcaccggacactctacagtgcatgtccggtgcaccaccggacatcaaggcgggcccagagacagagctccaacggtcgacccaacggctatttggtgacgtggctgtcgcaccggacatgtccggtgtgcaccggactgtccggtgcgccatcgaacaaacagcctcaccaaacggctagtttggtggttggggctataaataccccccaaccacccaccattcatagtatccaagttttccacttctcaaccacttacaagagctaggcattcaattctagacacacgcaaagtgatcaaatcctctccaattccacacaaagccctagtgactagtgagagtgatttgccgtgttcatttgagctcttgcgcttggattgctttctctctttcattctttcttgtgttcaatcctcacttgtaaccgaggcaagagacatcaattgtgtggtggtccttgcggggaggttttgctcccggttgatttgagaagagaaagctcactcggtccgagggaccgtttgagagaggataagggttgaaagagacccggtctttgtggcctcctcaacggggagtaggtttgagagaaccgaacctcggtaaaacaaatccacgtgtctcacttcattattcgcttacgatttgttttgcgccctctctcgcgaacttgattatatttctaacgctaacccggcttgtagttgtgattatttttgagaatttcagtttcgccctattcaccccccctttaggcaactttcaattggtatcaaagcccggtgcttcattagagcctaaccgctcgaagtgatgtcaggagatcacgccaagaaggagatggagaccgtcgaaaagcccactacaagccacgggagcacttcatcggaagagtcccgcaccaagaggaaggagaagaagaagagctcctccaacaaagggaaggagaagaaatcttcttctcaccacaaagagaagaaggagagatcttcctctcacaagccacatcggaatgggggcaagcacaagaggatgaggaaagtggtctactacgagaccgacacttcatcaacatcgacctccggctccgatgcgccctccgtaacttctaaacgccaagagcgtaagaagtttagtaagatccccttacactatcctcgtacatctagacatactccattactttccgttccattaggcaaaccgccaacctttgacggtgaagattatgctaggtggagtgatttaatgaaatttcatctaacctcactccacaaaagtatatggaatgttgttgagtttggagcacaggtaccatccgtaggggatgaggattatgatgaggacgaggtggcccaaatcgagcacttcaactcccaagccacaaccatactcttggcctctctaaatagagaggaatacaacaaggtgcaagggttgaagaatgcaaaggaaatttgggacctcctcaagaccgcgcacgagggtgatgaactaacaaagatcaccaagcgggaaacgatcgagggggagctcggtcgctttcgacttcgccaaggggaagagccacaagacatgtacaaccggctcaagactttggtgaaccaagtgcgcaacctcgggagcaagaagtgggatgaccacgaggtggttaaggttattcttagatcactcattttccttaaccccactcaagttcaattaattcgtggtaatcctagatatactcaaatgaccctcgaggaagttatcgggaattttgtgagctttgaatgtatgatcaagggctccaagaagatcaacgagcttgatgaaccctccacgtccgaagcacaaccggtggcatttaaggcgacgaaggagaagaaggaggagtctacaccgagtagacaaccaattgatgcctccaagctcgacaatgaggaaatggctttaatcatcaaaagctttcaccgaatcctcaagcaacggaaggggaaagactacaaatcccgttccaagaaggtttgctacaagtgtggtaagcccggccactttatcgctaaatgtccattatcaagtgacagtgacagggacaacgacaagaagggcaagataagagaaaagaagaggtaccacaagaagaggggcggcgatgcccacgtgtgccgcgagtgggactccgacgagagctccaccgagtcctcctccgacgaggacgccgccaacatcgccgtcaccaaggggcttctcttccccaacgtcggccacaagtgtcttatggcaaaggacggcaaaaagaagaaggttaaatctaaatcctccacaaaatatgaatcctctagtgatgataatgctagtgatgaggaggataacttgcttaccctttttgccaaccttaacatggagcaaaaagaaaaattgaatgaattaattagtgctattcatgagaaggatgaccttttggattcccaagaggatcttctaattaaagaaaacaagaaacatgttaaggttaaaaatgcttatgctctagaggtagaaaaatgtaacaaactatctagtgagctaagcacttgccatgacactattgccaaccttagaaatgaaaatgctagtttaattgctaaggttgattcgcatgtttgtgatgtttcaattcccaatcctagaaataatgatgataatttgcttgctagaattgaagaattaaacatttctcttgctagccttaaaattgaaaatgaaaaattgcttgctaaggctaaggattttgatgtttgcaaagctactatttctgaccttagaactaaaaatgatttgttacatgctaaggttgttgaattgaaatcttgcaaaccctctacatctaatgttgaacatgttgctatttgtactagatgtagagatattgatgttaatgctattcatgatcacatgtctttagttaaacaacaaaatgatcatatagcaaaactagatgctaaaattgccgagcataacttggaaaatgaaaagtttaaatttgctagaagtatgctctataatgggagaagcccgggcatcaaggatggcattggcttccaaaggggagacaatgtcaaacttaatgcccctcctaaaaatttgtctaactttgttaagggcaaggctcccatgcctcaggataacgagggttacattttgtaccctgccggttatcccgagagcaaaattaggagaattcactctaggaagtctcactctggccctaatcatgcttttatgtataagggtgagacatctagttctaggcaaccaacccgtgctaagttgcctaagaagaaaactcctaatgcatcaaatgatcatgctatttcatttaaaacttttgatgcttcttatgtgcttactaacaaatccggcaaggtagttgccaagtttgttgggggcaaacacaagggctccaagacttgtgtttgggtacccaaagttcttgtttctaatgccaaaggacccaaaaccgtttgggtacctaaagtcaagaactaaaattgttttgtaggtttatgcatccgggggctcaagctggatactcgacagcgggtgcacaaaccatatgacaggggagaaaaagatgttctcctcatatgagaaaaaccaagatccccaacgagctatcacattcggggatggaaatcaaggtttggtcaaaggattgggtaaaattgctatatcacctgaccatactatttccaatgtttttcttgttgattcattagattacaatttgctttccgtatcccaattatgtcaaatgggctacaactgtctatttactgatgtaggtgttactgtctttagaagaagtgatgattcaatagcatttaagggagtgttagagggtcagctatacttggtagattttgatagagctgaactcgacacttgcttggttgctaagactaacttgggttggctctggcaccgccgactagcccatgttggaatgaagaatcttcacaaacttctaaagggagaacacattttaggactaaccaatgttcattttgagaaagacaggatttgtagcgcatgccaagccgggaagcaagttggcactcatcatccacacaagaacatcatgactagtgataggccactggagctcctacacatggatttattcggcccgattgcttacataagcatcggcgggagtaagtactgtctagttattgtggatgattattctcgcttcacttgggtgttctttttgcaggaaaaatctcatacccaagagaccttaaagggattcttgagacgggctcaaaatgagttcggcttaaggatcaagaaaattagaagcgacaacgggacggagttcaagaactcacaaatagaaggcttccttgaggaggagggcatcaagcatgagttctcttctccctacactccacaacaaaatggtgtagtggagaggaagaatcgaactctattggacatggcaagaaccatgcttgatgagtacaagacaccggatcggttttgggccgaagcggtcaacaccgcttgttacgccatcaaccggttataccttcaccgaatcctcaagaagacatcctatgaactcctaactggtaaaaagccaaatatttcatattttagagtttttggtagcaaatgctttattcttgttaaaagaggtagaaaatcaaaatttgctcctaaaactgtagaaggctttttactaggatatgactcaaacacaagggcatatagagtctttaacaagtcctcaggacttgttgaagtttcttgtgacgttgtgtttgatgagactaacggctctcaagtagagcaagttgatcttgatgagataggtgaagaacaggctccatgcatagcgctaaggaacatgtccattggagatgtgtgtcctaaggaatccgaagagcctccaaaagcacaagatcaaccatcctcctccacgcaagcatctccaccgactcaaaatgaggttgaagctcaagttgatgaagtagaagatcaagcaaatgtgccacctcaagatgatggcaatgatcaagggggagatgcaaatgatcaagaaaaggaggatgagcaagaaccaaggccgccacgcccaagagtccaccaagcaatacaacgagatcaccccgtcgacaccatcctcggtgacattcataagggggtaactactagatctcgtgttgcacatttttgtgaacattactcgtttgtttcctccattgagccactcagggtagaggaagcactacaagattcggattgggtggtggcgatgcaagaggagctcaacaacttcactagaaataaggtatggcatttagttccacgtcctaatcaaaatgttgtaggaaccaaatgggttttccgcaacaagcaagatgagcatggtgtggtgacaaggaacaaagcacgacttgtggccaagggatactcccaagtcgaaggtttggatttcagtgaaacctatgcacccgtagctaggcttgagtcaattcgcatattattggcctatgctacttaccatggctttaagctttatcaaatggacgtgaaaagtgccttcctcaacggaccaatcaaggaagaggtctatgttgagcaacctcccggctttgaagacagtgagtaccctaaccatgtttataggctctctaaggcgctttatgggctcaagcaagccccaagagcatggtatgaatgccttagagatttccttattgctaatggcttcaaagtcggcaaagccgatcctactttattcactaaaactcttgacaatgatttgtttgtatgccaaatttatgttgatgatatcatatttgggtctactaacgaatctacatgtgaagaatttagtaggatcatgacacagaaattcgagatgtcaatgatgggggagttgaagtatttcctaggattccaagtcaagcaactccaagagggcaccttcattagccaaacgaagtatactcaagatattctaagcaagtttggaatgaaggatgccaagcccatcaagacacccatgggaaccaatgggcatctcgacctcgacacgggaggtaaatccgtcgatcaaaaggtataccggtcgatgattggttcattgctttatttatgtgcatctcgaccggacattatgctttccgtttgcatgtgtgcaagattccaagccgaccctaaggaatcacaccttacggccgtaaaacgaatcttgagatatttggcttatactcctaagtttgggctttggtaccctcggggatccacttttgatttgattggttattcggatgccgattgggcggggtgtaagattaataggaagagcacatcggggacttgccagttcttgggaagatccttggtgtcatgggcttcaaagaagcaaaattcggtcgctctttctaccgccgaagccgagtatattgccgcaggccattgttgcgcgcaattgctttggatgaggcaaaccctgcgggactacggttacaaactaaccaaagttccccttctatgtgataatgagagtgcaatccgtatggcggataatcccgttgagcatagccgcactaaacacatagccattcggtatcattttcttagggatcaccaacaaaagggggatatcgagatttcatacattaacactaaagatcaattagccgatatctttaccaagccacttgatgaacaatcttttaccagacttaggcatgagcttaatattcttgattctagaaattttttttgctaaacttgcacacatagctcataagtatacctttgatcatgtctcttttatatgctatgactaatgtgttttcaagtgtatttcaaaccaagtcataggtatattgaaagggaattgaaatcttcggcgaagacaaaggcttccactccactctactactcatcctttgccgtcgctccgcatcactctccaactttggtataatcttcactcatttatttcatgaccaaaggaggagaaagtacttcatagggctctaatgattccgtttttggcgattcatgccaaagggggagaaaatatgagcccaaagcaaaaggaccgcaccaccaccctaattttaacattcttaattggatggaaaatttcaaaattggcatctctttgtgttctaaagggggagcaagtagtattttcaaaattgatgtcttaaaaccctcttgaacactaagaggagaatttatttgagggggagttttgtttagtcaaaggaaaagcatttgaaacaagggaagaaaatttcaagcttgaaaatgctttgcaaaatcttattcatttaacctttgactatcttgcaaaaggtttttgaaaagaatttacaaaaggatttgcaaaaacaaaacatgtggtgcaaatgtggtccaatatgttaaaaacaaagaagcaatccatgcacatcgcgtaagtatttatattggctcaattccaagcaacctttgcacttacattatgcaaactagttcaattatgcacttttatatttgctttggtttgtgttggcatcaatcaccaaaaagggggagattgaaagggaattaggcttacacctagctcctaaataattttggtggttgaattgcccaacacaaatctttggactaactagtttgctctagtgtataagtaatacaggtgccaaatgttcacacttagccaataaaaagaccaagtgttgggttcaacaaaagagcaaaggagcaaccgaaggctcctctggtctggcgcaccggactgtccggtgtgccaccggacagtgtccggtgcaccagaggaattcaactcaaactcgtcgccctcgggaaattccagagcccgcgcgctaaaattcactggactgtccggtgtacaccggacagtgtccggtgctcatttgagacgcggctcaggaactcgccagtctcgggaactcgcgaaggctgctccgctataattcaccggacatgtccggtgtgcaccggactgtccggtgcaacctcggggcaacggctacttcgcgccaacggtcacatgcaggcgcatttaatgcgcgccagaagcgcgcagtcgtcaggcacgcgggagcaggcgcaccggacactctacagtgcatgtctggtgcgccaccggacatcaaggcgggcccagagacagagctccaacggtcgacccaacggctatttggtgacgtggctgtcgcaccggacatgtctggtgtgcaccggactgtccggtgcgccatcgaacaaacaacctcaccaaacggctagtttggtggcagccaagcgtcaccaccgagcaggttgaggagtgccacgttctgggtcagacagaagcagatcccaacgactggagggaactaattatcagatacataaaaaacaaggaagaaacagatgataaagccacaacagaacgcatcgcgggacagtcggcccagtatatcatcatagggggtctactatatagaagaggggcagaaggagtcctcatgaagtgtgttcactcgactactggaaggcagctgctggatgagatctatgcggggcaatgtggcgtgcatgcagcatcgagggcattagtagggaaaactttcatgtctgggttctactggccaacaacgaagaatgatgcagcaaagttggttcagaggtgcgaagtatgccaattcttatcaaagcagcaacccttaccagcccaatagttgcagactattcctgtgacctggcctttcgcatgctgcgggctgacatgatcggccctttcaaaaagctcagggggataccactcaccatactggttcgccattgaatatttcaccaaaatggaaagaataacaaagcttgttgcccttcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagttgttaacctacctaaatccatcattagtggtgtatgggaaagtcgcgatcccttggcagatggataacatgaattgtgagtaaagatgagcaacttctgcagagtgtaaaactggtatactagccgtgctcacggtcatgagcagctcggaccctcacatgattaatttatggaactaaattcaatttgtcatatgcattgcatcgcaggtgatgttgttacttttgttctactgcttaattgggttggtatttacttatacttagtaattgctaataaaattttgaccaactttaaaagcaatgctcagctctaaccatcctcccccaaccacccaccattcatagtatccaagttttccacttctcaaccacttacaagagctaggcattcaattctagacacacacaaagtgatcaaatcctctccaattccacacaaagccctagtgactagtgagagtgatttgccgtgttcatttgagctcttgcgcttggattgctttctctctttcattctttcttgtgttcaattctcacttgtaaccgaggcaagagacaccaattgtgtggtggtccttgcggggaggttttgctcccggttgatttgagaagagaaagctcactcggtccgagggaccgtttgagagagggtaagggttaaaagagacccggtctttgtggcctcctcaacggggggtaggtttgagagaaccgaacctcggtaaaacaaatccacgtgtctcacttcattattcgcttacgatttgttttgcgccctctctcgcgaacttgattatatttctaacgctaacccggcttgtagttgtgattatttttgagaatttcagtttcgccctattcaccccccctttaggcgactttcagaagtactgtgtataatagcttctgaacttgagggtaccttatcttcgagggaatgaggacttcactgatgaagtaaaccggatgttgtactggttatgtgcgcccttcttcttcctgcttaactaccaacacagtgcttaccacgtgagtcgtgcaggagatatatagtagcaggtcttcagccgactgattggatgtagcttgacatggcggcttgagcactggcggcgtggtcagaaactttttcagtgcctccaaggcttcttgagcttcggtgatccactagaatttatccacctttttgagcaacttatagaatgacatccctttctcacccagcattgatatgaacctgctcagcgctgccatgcatccagtgagcctctgtactttcttctgtgatcgtggtggctccatcctcataatggcttcaatcttctctggatttgtctctattcctcaatggctgacaataaacccgagtagctttccagccggcacccagaacacacacttttctaggttcagtttccatcgatagcgcctcaagctgttgaagacctgttgcaaatactcgatgaagttgtctgagttttctgtcttgatgactacatcatcaacataggcctctattcgcttgccccagtggtcggctaagcatgtttggatggccctctggtaagtcgctccagcgtttttgaggccaaacggcatggaggtatagcagaaggctccaaattgtgtgatgaatgtagtcttctcctcatcttcctttgccagactgatctgatgatatctggagtagcaatctaggaaggagagcatagagcagccagcggtcgagtcaactacctgatctattctagggagttcgaagggatctttcgaacattgcttattgagatcagtatagtcgacgcacatgaaccaatcaattttattctttttgagtacaagaacaggatttgccagccattcatgatgtagtacttctttaatgaaccctgccgacaccaggcgagctaattccgctcgaatggcttctcttttgtcaggcgtgaaacaatgtagcttttgtcggatccgccttgcctgagggcacactttgagtttgtgcttggccagctctctcaggactcccggcatgtccgcaggttgccatgcgaacacatcccaactgtcttgcaggaactggacgagcgcgctttcctatttgtcgtcgaggctagagctgatgattgcagtcttgcgttcattagagaatctcagattgatccttttagtctccttagtcggccgcatagaggtcgcagccggagcttcattcgaggggatcgtgaaattttcatccaccagcttgccatcggcatatgcgggaagggctaccggggtcccggcagtgagagtcgtccgaatggctccccaaaagcatcacgtggcaccttgcaagtcggcgcgcatgctaataatcctctgaggccatggcatcttgagtatcatgtacgagtagtgtggaatagccatgaattttgtcagtcctggtcttccaatgatggcattgtacccgcaatcgaagcgtgccacctcaaaccttaggaactcagttctgtagttctttgggattccaaaggtgatggacatgtagacgtgtcctagtgggtactctcctttggtcggcacgatgccaaagaaaggagtatccgactcagtggggtcgtcgatggcgacccccagggcctagagtgtctgggggaaggtgacgttgatgctgctgccaccatccactagcaccttcttcactggctttctcggatcacaggatcgatgagtagcggatatttgccggggtgatctaagttaagccactgatcggctcggctaaaggttatcacatgctctaaccatcggtaaggagccggagcactgttcgtggccactaggacctgtcgatcattaagctcttgttgccttctactttcttgtgctccatggccttcgaatatgacattgacctccctgtcaatgcgtgggaaagctcaacccctcccccttcctgccgctgaggctgcctaggatcgccaggctctcctcagggcgggggaggtggtagtggttggaacggtcggccatgcccaacggagtgtttgaaatctctgcagtcccgcagggtgtggcgcatgtctttgtgatacagacactaggagtcgaggatcttgtccagtgttcatactcctccgtggggtgcgccgcgagctcgagcagtaggtggcccgacggtgtgcacctcctcgcggggcctcttttcccagcgtttgtccgattgttggttcatgtcccaccacagcgcgggtggtgcgggttttgcgcctccgatgaggtactgagcccgctcatccatggtgatgtagatgttcgcctccctaaacaattgttcggaggtggttggtgccttttgaagtatggcccggacaaaggccgggttgttggatccccgatagaagtcttcaatcacagcagccttagcgacttcaggaatacgattcctcattgtttgaaatcttttgaggaacgatcggagagtctcatcattctaacgcctactggattataggtcccatggctgcgccggtttatcggagagagaccagaagttcacgataaaccgacgactgaagtcactccagtcatcgatgcagtgttgaggcaggtgtcggagccattgcaacgcgtcctgccctagaacaatgggcaagtacgccgtcatgacgtcctccattgccccagtagcccaagcggcagttgtatagacagccaaccatcctcccgggtcctgcttaggctcatatttgtcgacgttggagaccttgaagttaggaggccattggatggcccggaggcaaggagtaagcgcggaaactccgcacgcatcctcttgccgatgatcgcgccatcggtcccggggaggggagtcggtattaggtcatctcgaccgttcccggaatggactttttgttgaagctgccgttgactcgatccatgttgcacggctgcgcgccggtacaccatgatctcggtcgtactcctcccggcaccttgtttcattctcgcgtcgtcggtcgcgtgaagcgctgatggtgcttcacgcgtctcatcggctgttgatggcgtgacgcaggtcgttcgcaggatgagcgggaggtagaagatgattggccgcctaagtaagctgccgtcgataaccctcctcatctggggttcaggaaggccgtcggctatctgcgccaacactcctccgacttcactcgacgtgttcaatgcccgagcgaagtcagggtataggtttcgagtgagaagaggattctcccgccggagtctagcatcttattcagctagttcctcctctcgttcttgagcttgtcggcgatcacggcgacgggagttgcgtctttctcggtgtacccgttcatcaggagtttctcccacttctgaggctttgtcctgagatacaggtcgcactgggtcccgttctctggcttcatgatgtcactgcacattccgacgcctgtttctccatcgtcgggcatcacgctggggaggttcctccccctacagggtaggttcatcgtcgaagatgggaaatgactccaatctcccctgaatgaagaggacgtcggggtagaaaggagcatgtatggcggtgtgcttattcccattctcttttgagggtggaggtgctaggaggattgctcgctgtgttttccttccccggtatgggatattcgcttccttccttcgagtgatccgtgtccactccttagtgggcgagatggacaacggagttcttcgggcgggagaggcctcgaccggctggccttgcattcttcgggagcctttaagccctgacttgtgtggggccatgccctcttgggcagcgagcggaggcatggctcgcggactcgcttcagcttctcgtggaattcacgaggagggtctcttcttgggtggatctgctatgcggtgcagagttccttctatgtccgctacgcacgggatggttccgaagcagaacattgctcctgggctgagagtgatcttgctcttgaagatgatggccatggagctagcgttgatcaacgacaccccctacctggcgcgccagctgtcggtgtttagtgtccgaccgcacacccgggagtaccctcgtggtgcttttgggtaggacggtgtcacagattgtaacttgatggttcgtgccgtgggcacggggaaaagagagtcgagcgattttctgtaggttcaggccgcttgaggagtgtaataccctacttcttggggtgactttgtatgtgtggggtgtttacaagtggtgtctcccgagtggagaggtgctaatgagatgaaaatgatggggatctccctaggccttatatacacgaccgtagggcactctctgcacacatgctgatcacactcttctagcttatctcctagctaatagcgaccaaactttgcttatcctgaggaaaaccctgcacctccgttccgagctatccccggcgtttgaggaagtcgggcgtgggaaaagcgagcagcttcaacaggatcacacccaagccacgaataatctggacgtgagcccatcgcttttctaggtcggcccatttccaccgttgtctttgcctggcccacaacgcggtggccttgtggggcgactggcttgtggccccaagcagggtttttgccttctagtggacccggaggttatctgtcccgcacataaatggtatggatattatctgtccatattcgaattcgatccacttaagggtttgttcgattaggggtggattgaggggattagagaggattaaatcccttcctattcaattttaaatagaaaagggatttaaatcctctcaatcccctctaatccccacataaccgaacaaggcctaagagggcaaagatctgatccgtattcgagaccagcatcagtatctgattcgtattcaatttatatctatatatttatagttggatatttaatatgtcgacatccattctaatcttatccaacacaactcgataatattcaaatccgtatacaaaatacgaaaacaaatattgcaaaaaacattattcgtccgtatccgatccgattccacatctacctcttttatttaattttgactagcgagagatttaatccccttcgatccggacgcaatcgaacaaacctttaaatgctagtttggaaacataaatctgcttgagttcccctttatttccggggtaataaatctctagaagtgatatttgaataagatatttagttatttgtgacagatttctttacctagatttagcttcccttgctcctaaactagatctaacgtcttgttcagttacatggatattagagccttagagggatggagagatccctatccgtacaagctctaaaataggaagggtttcgtacaacgcatcttcgcgcctcccctgaaagttcggaccctgactcaccagatcaagtccgagtctggttatcgatctgcatcctcagatcaactccgagtctggtgatcgatctgcaccgtatctagtataaatatcggcaagcagttttctccctgcagaagagaggtattcgaggagacgagagtagcgatggcgcgcagccgtactcgcagccccgagtcgactcgtcgtcttgctcatcgccttcgcgctatcaagccatccaagtccaaccaacagcatccccatcacgaacgtcggcggactgccggacgccgtccgccgggacacaacttcgccgaggagtggccgacgggcccggcgacgcgggcgatcctgaccggcttcgacgccggcctctcggcgcgtggcctcgccgacgagttggagcgcttggcaggcaccgtctggcgctgcaggatcaagacttccgtcacgccgcccgagtcctacccggacttccagctctcagtccacgccgccgccgccgccgccgtgttccaccaggacgagccgccgcgggacggtcgcgtggcccctcatgccttcgtccacttcgagcaccgcaatgccgcggaccgcgctggcgacttcttcacgacgcgcatcctcgcgcagagcagacacctgctacatggccatgcggcgcgccggcgggatggtgtcaccgacgccgccaaaccgatgctcttccccgactcgcgcatcgagatcggcgacgtcgtggcgccggacaccttcctcgtcgcgtggcgcgggaccgacgacagcgcctcggcgctcgacttcgtggtcgacccgtccggcggcagctgccggctgctgttcgcccgctacaccgccttcacgtgccccgacaggcgccggcccgcggcgctgctgtgctgcgacgtgaagctcgagttcgcgctcgcccacgtcgccgaggccctggcgttccaggccgacgactcgctggtcctgcggctctccgccgcgcccctcgtgtactaccgcacgtcgggcgacgacgtccacggccgcgtgcccttccaactcgtcgacgccgacgacgacccgtggatacggaccaccgacgtgacccggagcggcgccatcggccggtgcttggcgtacagggtctccttcgcggtgcagttctggccgacgatgagggtcgcgctggagtgcatgcagaggcagggggtccccgtccacgtacgcgacagacggtgccagggtttcaccgtgctcgaggaggcaggcttggtgcagccgatgcgggacgcgttcttctccccgcggcacgacgacgacgcaggggcagggctacggttcccggagctgtacttggtcaacgtgctgatgcacaacggggtagtcaatccgcaccagatgacaccggagttcttcggtttgctgatgaggacacgcgaagatgtgaacgttgctgcgctgacggaactgttcggtgcaaagcttggagtctgtgataatccatgctggaggttgaagaacgcgcaggacaaggctgccaagaatctcgatcttgtctgtcgcagcagcagcagcagaagaaaggctagtgattgcgatgctgaggtgcgaaggctgatcgtcactccaaccagggaatactgtatgccgcctcaagtggagcgctccaaccgcgtcatccggcattaccacgagctgtcagatcgcttcttgagggttacttttacggacgagggtatgctgccgctgaaccctaacgcgctgaccctccgtgcggtgccctcgacgtcgacgcccagcacgtcccggcagatgacaagcgtctacaggcgtgtccagacggccctgacggaggggctcatcatgtgtggcaggaggtactcgttcctcgcgttctcagccagccagctgaagcagaagtcggcctggttcttcgcggaggacggagcgacaacggtggcaggcataaaggagtggatggggcagttcccgatcaggaaccccgcgaagcacgccgctcggatggggctgtgcttcacgtcttcgtatgcgacggtgacgatgcagcccggcgaggtggacgaggacctcgaggacgttacgcgcaacgggtacaacttctccgacgggatcggggtgatcacggaggacctcgcgctggaggtcgccgagatgctgccgctggcggacaggttcgccccgtccgcgtaccagatcaggtacgcggggttcaagggcgtcgtggctgtctcgccgccggggccgggacaagaagaccgtgggacgcggaggatgtcgcttcggcccagcatgaggaagttcgagtccacgcacaacgtgctggaagtggtgtcctggaccaagttccagccagcgttcttgaaccgccagatcataacgctgctcaccaccctgggcgttcccgacgactccttctggcagctgcaggaagcgatgctaggcaagctcaggcgggttttgtcggacagcgatgtggcgtacgaggtcgtgaccaactcttgccctgagcaaggaagcaccgcagggctgatgctgggcgctggcttcgctcctgcgactgagccacacctgagagcgatgctactggccatctgcacctcgcagatgcagggccttctgaacaaaacgtggatctttgtgcccaagggaaggtggctgatgggctgtctcgacgagtttgggatccttgaacaggggcagtgctttctccgggtctcgacgccatcactcggcagccgctgcgtgaaccgttctccgatatttccctcggaatataagggcgatgccaatgcacaggtgattactggtacggttgtgatggcgaagaacccatgccttcatccaggggacgttcgtatccttgaagctgtggatgtccctgatctgtatcaccttgtcgactgcttcgtcttccccaagaaaggtgagaggccacacgccgacgaagcttccgggagcgacctcgacggcgacgtctacttcgtgacgtgggacgagagccttgtacctcctgggaggaagagctgcaccccgatggactactccccggctaaaacaaagcaacttccacacgacgtacaccaacaagtaagtacaaagtaccaccttgcttcttcctttggtttggcttgctgccataatacatcaagttaatggatttctcgtgtgctcttgctgtaacaggataccattgatttctacttggagagcatggtatacgacaaccttggtcgaatatgcaacgcccatgctgctcatgctgatcggagcgacgacggagctatggatcccaagtgcattgagttagctcggctcgcatctatcgccgtggactccgccaagaccggggaaattgtgagaatgccaccagccctttcaccaaaagagtaccccgacttcatggggaaggaggacgccatctcttacagatccgaaaagatccttggaaggctctatcggtcagtcctaggggaaaatgacggcgattttctgtcacgaggcgcatgcatttcagatgagattcgatatgacgccgatctagaagtccctggcgcctcagactttcttcaggatgcttggcgatgcaggtgcctgtacgaagctcggctgaatgccctgctcgatcaatacaatgtgcgcagtgaggctgagctcgtgacaggggagatatggtcacttgccggatgcagcaagaagtatcagcatcaattaaaagagaggatcaactatgcgtactccaaagtccaccaagagttccggatcatctttgagagcattggtgcctctactgacaacaaaaacctggcgtatgagatgaaggcgtccgcgtggtaccaagtaacgtatcaccctgaaatcatccgatcaagggagcctggtgatgaggatgcacctacgagacttagctttgcatggatcgcagttgattacttggcacaaataaagatgaagcgccacgtagactag

SEQ ID NO: 698 - DNA, 5322 bp, Zea mays
acctaggcatacctttgcttttaatgtatacaactatgttaatttttttagtttaatgagtttcatgatgttaatattatcaacctatttattataattgctataaaggatattttgtatgactataggtgctaaaatctatgataaatataatatgtatgtgtgcactcaataacacacaacttttttggttaatccctttatcatatcattatgtttaaatttaccatgatcattctggtatatcataacactcacattcacatatgaagtctgttgaccgaccaccatcaatcctaaacttatcacaattgaatcaagccaggagatttttagtgtggatataccacggaccgcttgagatgttacaaaccaaaacacatcaatagatgctaccgatggatcatcacagcagctgtaacattgtaattccacttagcatgaacataatactggcctgtcagtgtctgtatatattcgcaaaggtatcaagagatctgctggccggggacgcaaatcattggatgactcttcaaatccaaagaacgacgatgacttcatgcctcccctaaagggcaagtgtcgcgttacttttgatgacctgttgcgtcttgcgtatggatcgaagggatttaggagattacatccctttcttagagggtgtaaatggtatgaatattatatgtctatattcgaattcgatctgcttaagggcttgctcgattagggtggattgaggggattagagacgattaaatcccttcctattcaattttaaataggaaagagatttaaatcctctcaatcccctgtaatccccacacaaccgaaacaagacctaagagggcgaagacccgatccgtattcgagcccggtattcagtatctgattcatattcaatttatattcgtatattcatagttggatatttaataagtcgacatccattctaatcttattcaacacaactcgataatattcaaatccgtatagaaaatacgaaaacaaatattgcaaaaacattattcgtccgtatccgatccaattacacccctacctcttttattcaattttgactagcgagagatttaatccccttcgatccggacgcaatcgaacaaaactttataggctagtttggaaacataaatctgcttgggttcccctttatttccggggtaataaatatctagaagtgatatttgagtaagatatttagttatttgtgacagatttctttccctagatttagcttcccttgcttctaaactagatctaattgtcttgttcaattacatggatattagagggatggagagatccctatccgtacaagctctaaaataggaagggctttcgtacaactccgagtctggtgatcgatctgcatcctcagatcaactccgagtctggtgatcgatctgcaccgtatctagtataaatatcgccaagcagttttctccctgcagaagagaggtattcgaggagacgagagtagcgatggcgcgcagccgtactcgcagccccgagtcgactcgccgtcttgctcatcgccttcgcgctatcaagccatccaagtccaaccaacagcatccccatcacgaacgtcggcggactgccggactccgtccgccgggacacaacttcgccgaggagtggccgacggggccagcgacgcgggcgatcctgaccggcttcgacgccggcctctcggcgcgtggcctcgccgacgagttggagcgcgtggcaggcaccgtctggcgctgcaggatcaagacttccgtcacaccgcccgagtcctacccggacttccagctctcagtccacaccgccgccgccgccgtattccaccaggaccaggacgagccgccgcgggacggtcgcgtggcccctcatgccttcgtccacttcgagcaccgcaatgccgcggaccgcgctggcgacttcttcacgacgcgcatcctcgcgcagagcagacacctggtacatggccatgcggcgcgccggcgggatggtgtcaccgacgccgccaaaccgatgctcttccccgactcgcgcatcgagatcggcgacgtcgtggcgccggacaccttcctcgtcgcgtggcgcgggaccgacgacagcgcctcggcgctcgacttcgtggtggacccgtctggcggcagctgccggctgctgttcgcccgctacaccgccttcacgtgccccgacaggcgccggcccgcggcgctgctgtgctgcgacgtgaagctcgaattcgcgctcgcccacgtcaccgaggccctggcgttccaggccgacgactcgctggtcctccggctctccgccgcgcccctcgtgtactaccgcacgtcgggcgacgacgtccacggccgcgtgcccttccaactcgtcgacgccgacgacgacccgtggatacggaccaccgacgtgacccagagcggcgccatcggccggtgcttggcgtacagggtctccttcgcggtgcagttctggccgacgatgagggtcgcgctggagtgcatgcagaggcagggggtccccgtccacgtacgcgacagacggtgtcggggcttcaccgtgctcgaggaggcaggcttggtgcagccgatgcgggacgcgttcttctccccgcggcacgagcacgacgacgacgcagggctacggttcccggagctatacttggtcaacgtgctgatgcacaacggggtagtcaatccgcaccagatgacaccggagttcttcggtttgctgatgaggacacgcgaagatgtgaacgttgctgcgctgacggaactgttcggtgcaaagcttggagtctgtgataatccatgctggaggttgaagaacgcgcaggacagggctgccaagaatctcgatcttgtctgtcgcagcagcagcagcagcagaagaagaaaggctagtgattgcgatgctgaggtccgaaggctgatcgtcactccaactagggaatactgtataccgcctcaagtggagcgctccaaccgcgtcatccgacattaccacgagctgtcagatcgcttcttaagggttacttttacggacgagggtatgctgccgctgaaccctaacgcgctgaccctccgtgcggtgccctcgacgtcgacgcccagcacgtcccggcagatgacaagcgtctacaggcgtgtccagacggccctgacggaggggctcatcatgtgtggcaggaggtactcgttcctcgcgttctcagccagccagctgaagcagaagtcggcctggttcttcgcggaggacggagcgacaacggtggcaggcataaaggagtggatggggcagttcccgatcaggaaccccgcgaagcacgccgctcggatggggctgtgcttcacgtcttcctacgcgacggtgacgatgcagcccggcgaggtggacgaggacctcgaggacgttacgcgcaacgggtacaacttctccgacgggatcggggtgatcacggaggacctcgcgctggaggtcgccgagatgctgccgctggcggacaggttcgccccttccgcgtaccagatcaggtacgcggggttcaagggcgtcgtggctgtctggccgccggggccgggacaagaagaccgtgggacgcggaggatgtcgcttcggcccagcatgaggaagttcgagtccacgcacaccgtgctggaagtggtgtcctggaccaagttccagccagcgttcttgaaccgccagatcataacgctgctcaccaccctgggcgttcccgacgacgccttctggcagctgcaggaagcgatgctaggcaagctcaggcgggttttgtcagacagcgatgtggcgtacgaggtcgtgatcaactcttgccctgagcaaggaagcaccgcagggctgatgctgggcgctggcttcgctcctgcgactgagccacacctgagagcgatgctactggccatctgcacctcgcagatgcagggccttctcaacaaaacgtggatctttgtgcccaagggaaggtggctgatgggctgtctcgacgagtttgggatccttgagcaggggcagtgctttctccgggtctcgacgccatcagtcggcagccgctgcgtgaaccgttctccgatatttccctcggagtataagggcgatgccgatgcacaggtgattactggtacggttgtgatggcgaagaacccatgccttcatccaggggacgtccgtatccttgaagctgtggatgtccctgatctgtatcaccttgtcgactgcttcgtcttccccaagaaaggtgagaggccacacgccgacgaagcttccgggagcgacctcgacggcgacgtctacttcgtgacgtgggacgagagccttgtacctcccgggaggaagagctgcaccccgatggactactccccggctaaaacaaagcaacttccacgcgacgtacaccaacaagtaagtacacaataccactttgcttcttcctttggtttatcttgctgccataatacatcaagttaatggatttctcgcgtgctcgtgttgtaacaggataccattgatttctacttggagagcatggtatacgacaaccttggtcgaatatgcaacgcccatgctgctcatgctgatcggagcgacgacggagcgatggatcccaagtgcatcgagttggctcggctcgcatctatcgccgtggactccgccaagaccggggaaattgtaagaatgccaccagccctttcgccaaaagagtaccccgacttcatggggaaggaggacgccatctcttacagatccgaaaagatccttgggaggctctaccggtcagtcctaggggaaaatgacggcgattttctgtcacgagatgcatgcatttcagatgagattcgatacgacgccgacctagaagtccttggcgcctcagactttcttcaggatgcttggcgatgcaggtgcctgtacgaagcccgactgaatgccctgctcgatcaatacgatgtgtgcagtgaggctgagctcgtgacaggggagatatggtcacttgctggatgcagcaagaagtatcatcatcaattaaaagagaggatcaactatgcgtactccaatctccaccaagagttccggagcatctttgagagcattgatgcctctactgacaacaaaaacctggcgtatgagatgaaggcgtccgcgtggtaccaagtaacgtatcaccctgaaatcatccgatcaagggagcctggtgatgaggatgcacctacgagacttagctttgcatggatcgcagttgattacttggcacaaataaagatgaagcgccacgtagactag

SEQ ID NO: 699 - DNA, 7932 bp, Zea mays
gcaacagtccggaaaaaatctggatcattttagattttatattttcattttagattttatatattctgtccgtaacactaaagtttatttaaattatagagattaaactttagtccctaactattttaaattaaccccgtgccccctaattaatggaagaaggacgagagacactaggtgaaggtgtctaaccaatagaacatcatgctcaaatatttttaatattgaatataaattatatatatatatttttttgtaaaataaaaaaatataatcgtgtcgagccaggtcagtaccacgggccgaggctacaacccaatcacggcacgtcattcttggttcttgcaagcattaggtcgtttttgagactacattgacgcaatggactcaatgatgtttgaggttgttgaattggatggagcaacaataatttgtcacactaacagtaaaatgaaaggttatttgttgattttaaacgttagtaattgttacgaagtagcataatttatatggagcgcatccagttttattgatgcctgactttagcaatcactccatgttttaatctatcttttttataagtttgagttcatgtgacttattttagaaacttgagcacacaaactttctcttatttggtctctatatggtggaattatgttattttataatctctgttcgttcagtcagtcgttgtgaactctcttctaatcgctcacttcattgaccgtattgtattaagacatattggatggagtaaacaataacatcagttagccaaatcaaaaaatattatacggagagcggaaacaatcaatacaaaatcttgaatttttttggtggatagtttatatggacattattgtaaaccgtcgcaacgtacgaacaagcgactatatatatatatacacgataaatacggccatacatacataaatgttatcacgttactaaaagatctacaaaaatattaaacgttaacaaattcacgtaattgcttcataaaaacacatcacatggcacaatagaaaagggaaaaagtgaatataaaatagatttaaacatgcataatgtttccttgttgcctgtttgcatgtttttaatagatagttagttcattacgtgcgatgacccgtatgttgtgatctgcgagctacagtacttgtgtcagtttagcaccacttaaaagagagagatgagtaggctgatgcgcttagaaaaataaatatattcaagtggagtagtaaatgatagcttataaaaacaaaaataccatcgatattttcctgaaccataaatacaattcatgtatccttttatatttacttccgctaactatttcggttcaggtatccttttaattttctttctttttttgttttggttttttcccttgattattgggtaatcagtagatacggtaaacgatattcgcttggtatgaattttcctatcctattttctccctatatgaagactcgccccggaccctgtccactcaccactcaccacagtctccagtctccactgcatctaaaaaaaaacgtaaaacccccaccacgccgtagcggagagaagagaagagaggagcgcgcgatcgatgtcgggctccggcgatcgtcgcggcggcggtcctccgggttcccgtgagcacctcccgcctctccccctgttttcccttgtggttcgtgagtggacggatcgtgcaatgccggatcgtttaaggggtttgggtagggtttagggttgatttgcggggaattttctttcgaagatctgattcttttcgtgcctgcgggttggtcgcttgtgtcgctcgatttttttcggcggtttgtttcggtatgactggggttttggaggacgaggggcgaatgctgcttcgcgtgggtgcggaatcggtgggcttgtttgagcgttccagtgggttgtcagcgctttgcgcggatccgtggtttgtgatatttttacaatcattccgatttctgttcgcgagtttaggttttacgtcttgaacaggggttcaagttatgttgttgattttatatagttttttttcgttggtcttaatcaagtctgatactcgttcagttgtctcctcataaggttacttcttacttgcatggttgctggtgtcattttttttaataattgctgttcatctttttagtttgtgttccactttatctcattctttgataacacactgaataactgaatgattcttgacaaaattatgttactgcattggtttggcattgtagatctggtaaactctggctatgtacatttcatcaagtgaaaggcttgatgtatgtgatttacttatgtggtggcagcatgttattcctattgcagagttgattttgtatgcattttttgtgattgcgatgcatactttgagcctagtgaaattagcacggtggccaccaatggttatcttaacgggtattggtcctatgatgacttgcatgtatctcttgacaattagatctgcagctagcttttggtcaatatattagctaccgagagaactttgataattatgaaattactatgttgaataggtaaaaagtaattagcatcattgtgtttcatagtggagtatgatgttcattgccattactaacagatacatgctgatattaatttatctgaccctgcataatggtaccctgcatacagatagtggctgggaaaccatggggaagaagtcgaagaaacccgggcaagccggggggagacagtgggcaccatggagttccacaaatgtgacacctaacacagcaaggccagcatggggtggcagtggttcctcgcacccttctggaaccagctgggctcaagctccagatcatggtgctgctaccagaggcaatcctagaccgccatcacaaacatcgcgccctgttctggctccacctctggcaaatggttggcagtggcaatccaggcctcgcccatctggatctgaagtcaagaaggatgatgctcctccatctggttctgtccctgaggtggagaatgttgatggcaacaatacatcagatgatgatgatgatgatgacgatgatttgagtgatgatatcagtgatgactatgattctgacgcaagtgagaaaagttttgagactcgaaaaacgaacaagtggttcaaagagttctttgaagtattgaatacattgagtttggaacaaattaatgaacaaactcggcaatggcattgcccggcatgcaaaaatggacctggggcgattgactggtacaaagggctgcagcctttagtgagtcatgctagaacaaagggttctacaagggttaaacttcacagggaattggctgcattgctggaagaggagctttctcgcaggggaacttcagtgttaccagcgggtgaacaatttgggaaatggaaaggactgcaagaaagcactgatcgtgagatagtgtggccaccaatggttattgttatgaataccttcttggaaaaagatgaagatgataaggtgactgattttttaatatataatttatattagcagtatgttttccctgtgaaatgctaagtacagattttgcagttgggttccctcatcccttttaagcataacttaacacctatgcatcttcttagagcctttgatctgactgaacaaaggtgcaatatgctccctaagtggatcagtttatattacctttctatatttattttgtgttgtgcatgttgaccacaatgatcctctttattatcttatatataataccattcttctaattggcttcaatacattacgtccccacatttttgtgagctgagttggattataaatgcttctttctaagatcttatagaaaaagacctttatatctttcaagggccatacagttaagttgcattgcattctgatttctgtttgtttgttgacctgatctagtggaagggcatgggaaaccaagagctccttgattattttggagaatatgaagcaagtaaagcacgtcatgcctatggtccctctgggcaccgtggtatgagcgtgttaatatttgaaagctcagctgtgggctacatggaagctgaacgtctgcataaacactttgttaatcaaggtacagacaggaattcatggcacctacgcaaggttcgatttgtgcctggtgggaaaaggcaactatatggtttcttagcaaacaaagaggatatggaggcatttaacaagcattgccatggtatgttttcttacaaacttaatgctttctgttctgtgtatatgtttttttattctggttaacaacatgatttagtggacttctccccaaattctttatgccttgaataatgatatctgttaagtctgattaaaacttgtacatgtgaaatatttttttgttacaggaatcataaggacacatgaagttcaatatttctatccttccacttaattgacataggatgtgtttggttttggttctgcttttgaaacctgctgaaccaaagggttcagcttttttgtagctactttgaaaaaactgcttttctatagtacaaatttgaaagcagcttggaccctgcttttgctgcttattgaagtttgttatattaataaacagacacaataaactgaaactaaaataggattaaaataattaagtgttataataaatgaaataataatatttttaataaaaagtattacaaatggaattaaaaaattgatttatttttgaaaatatcagcaatacaaatgtgaaatcacttcttaattagacatattgattaagagatatagttaaacaaagtgcatataaaaaatatacaatttgtttacagtggacaactcacaacattttgaaccaaatggatttcagcttttttctcacagcaacttttcagggtaggcagctcacagtagttttttcacaggtcacagctaaaccaaacacacccatattatatgattgttacttttagtaatcattttgttcatccattggtaatgcatgtttcaatagtatgctagtatttattttgtgcctagtcctctgtggtctttccttttgctttacatcgtgcttatgatcatttctgtggtggctgaaccacaacgtcagttttataacaatttaatttttagaagtgcatcactctgtgccctgtctagaattgtagtagcttttcaatagcacttgcttgtgcttattccatttacatttggaaaaagttcatgactttgcttatgcttgtacttctaataataattttgataacctattgataattggtcctatgttgttttccatttttttccatcctgtttaacctattaaggccaagcaaagtttttatggtggcagaaacataacatcagtcttatttcatttaatttttaaagctcatcactatatgctctgtttggaattcggatttgttctttctcaagagcagttgcatatttctaaatctggatgcagcacttagatgaaagcatcttgttttggagagcaatagcagcaaaatcttgctaatatttcataaccaactaacttaatccacagtgaagcacaacttaaaatggcacttacttttcgatagaacgaagaacgatgcacaagtctgcatatttccttctttttataggtcaattagttttggacaatcatgtgacaagaggataccacagaagctaaaaggcaagtagcaagttttataggatgacgattagatctgttatgttgtatgctgtagaatgttggtctaaaaaagatgtcatgttcaacagataattgatgtagaaatgcgtatgttgcattggatttgtggccatacaagaagttattgagtctggaatgatgatatatgtgtccaatggagacctatagagtcaccaatgcgtagtgggatctaaggcatgataggaatgggaagggagacaaggaaaggctgaagttgacatgggaagaggcagtaaaataagacttaaaatgatggaatatatccaaaagtttaatcttgaataggagcgaatgaaaaatagctgtctgtgtgcctgaaactagatttgtggcttctgttaggtttcaactttagcctacctcaacttgcttagcaaggttttgttgttgagttctaggcatttgattagtgcagctcctttattcaaaggtctgcttgtgaaggggggatttctctatgaacttttggagcgtttccttttctactaaatcaaaataatatggccaatatcgtttcctgttacgaaacatcaaaacagatgcttcttttcttcttgtgccattgtgaaaatacatcacccacttttcaaacggtacaacagataaatcaatctctaacctgtttattgaaatatgaagccttccaagtccaagtggagtgtctttgaaatacagacatcaagctgtagtagttatgttgcatctaccgagcaggacgccgagcattttaatagctaactatatttttatcttcactataatttcaggtaaaagccgtctgaagtatgagatgaggtcttacaatgagatggtggtgattcaaatgaaacagatgagtgaagacaaccaacaactgaattacctgaagaacaagatggttaagacagagcagcgatctaaagcagtagaagaatcattgggtgttgttacccagaagctacgtgagactattgaagaaaatatatttgttaggagtaaagcaaaagagaagcacatggagtacgaggaagaggtaataaggttacccaagtggttatattttctactaatgaacatgcgtggatcaacaattttcatctgtgccaatgatagagtttgctgtttcttggagggtcacacttatattttgcactttgatacttctgtgataagattgatgctgccagctttcaatttgaccacctgttgttgaccacttgaccttgatgttgccatctttcgatttcactacctgttgaccttgtttccatgctttgcagatgaagtcccaggaggaaatttttcatggtctaattgaggatattcacaaggccacagaggataaagaaaagcagtttgagaagttgttgcaggaagagcgctcaaaggccagacgctttgatgttgattctggaactatgaaagatcgtcagctaaggtgtgtcactaattcgtggttggatcatgttaccatgcctcaccacaattggaactaaaagtaatgtaaatgctccatctcaatgcatatgagagtcgtcaagaactgtttcctgctgcagtcgtctcatgtaggcatcacaggttcaatgtgcatatctgttgctgtttatcattctcaatccatccgcgtcttgtgcaggaaggaatatgtgcagaagttcattgattgccaagtcaaggatgtggcagagtttgaagttgagcgagatgagctgatcaaagtccacgaggacaagaagttgaagctcaagaaagaatacatggatctggagctggagctggagaaggagtttgacgcagccctgacgggcctgatggagaagcataagccagataccttcgaggcctccagctcgtaagggggcttcagcggctaagcgctttccttaggccccagctaagcttggagcagtctcgtacatgctcctgcttgcttatccatgaaataatgcctggacagtctgtagatgttgcgaaaacatggtgccccctgtggttgccgcgtgtgtagtaagtatctctcagtcgtagtgtggttgaagcatctgaactcttgagcggtttgcctgtgatggcatatgggtcaaactacaactggagtgtgatatctagtttatatggtccagcgctcttgttgactgcgggtggtggtttgccccggataatttactgattatgtctgctccgatcgtcaaagtgcctctttctgttttttttctt

SEQ ID NO: 700 - DNA, 14528 bp, Zea mays
cccattgccggttatgccatgtcagacaatccacacgagaaaaatactgatttcgactcaactgtgcaggcccgcctgacacaaccagatgctctaagcaagggtgtagtattccctctcgtgctggtcaaagtcgagagcagcaaggacatagatcgcgtagatgattctggtgacataaccaaggattgtgagcagcagccagatgcagaactctatctgttaagaagatagagttctcttgcaccaacctcaaatacgtgcttctgattgtgttaagcgtgtgattcacacaaacatgtgaagagattatacctgaaccagattatcttatagtgccatgtaattgccttgtgtgtcccacaaaattgagatgtccatgggagaaaagtagaataagaggtgctactgtagcattatggtaccactgtttgatgttttgaaaatttgtaagtcaactctcctgagtctggaacgatttaacttgtgtgctttggactgatggccaaagtatgcatatgctgtgtttgctgaatttttgcccccaagccccaattggaccattgcgaccacattagaaggcagtacatgtattcaacagaacatgtgaagaatgagtattgtttgcataaattcgatagccatgcctagacttgctatgcattgccactgtatttggcatgcctagaactgctacacaaaacttgctatgtattttgtctaaaaatactatatccttgatatgcttgcttgatctatattttttctgctcttctattcttgtgtgggtttatcaagaatgaggcaattagataagaatatatgctttgtcaatattgtctgagactttgttaatattagaaggcagtacatgaattaaacaaaaccattgttttgtttattatgatctgaacaactcattttatatatggagctcgtggcaatggcagccccgcaaaaggatgatggaactcatggcgttgagtggtggcgtgcttaggctcgtgatcctctgcaacgaggcactgtttcccacgagcgttcccatcaccattgcagtcacgccacacgtcgctaggccttgagcggttggaggctcgtcaatttgtctttcgtcgcaacgcacgggtatatacctagtcactatataactattcgatatgacttgtttaattttttaatacatatatagacaaacaattgtcagtggattgtcgtgctagcaacttttaagccagatattagctgtagcgcattcaacgcaccgccgatgataatattcatatcagattaaccctgcacgggtcccgagctactactaatcataataaatgccgtttttatacggaataccagaccagttgtccgagggcctgcttgccaagttgtcagtaactgtggagagcacgagaaagtggggcatctactttttttagactactgctctcggcctcctctccgctccattttcgcaattccttcgagctccgctccggtgaagggcgctccattttggagatttcgcaacctctgcctcgttctgccatttttttttcttgcctgcaccaacgtcatctaaccagtcattagttggtgaaatcctccactcccctgcagaccacgtcagccttcaccttgccgtctccgttacgcgccgcgagcccgcgagcgtttggggagttttggagcggaggaggcaagggaggacggacagggaagtttggttgtggaaatggatgtggtggaatcctcgccgtcgtcgtcgccgatatcgtctccggccgggtcttcggagtccatagacctcaacttcctgccgttcctcaagagggagcccaagtcggagcccgcgtcaccagagctcgggcccctgccgctgcctgcgcccccaacccagacgccccagcagcagcatgcagcggctccggctcctgaggccacggcgcctctgtcgccagcgactcctgacctctcgtccgctccggtgatggcgccgctgcagtcgctgccgcctaacctggacgaggacgcgctccttcgggagtactaccgcctcgcgggcctctacctctcgtctgcgaggtccggggcgatcatcccagcgctagctccggaggcggccgcaccggcggtggtgcagtcggggtccgggtctgtcgtgaagaagcgccggccgcgttcgtcggacctcgtgcgggtctcctcgctcggcgtgcaggaccagatctacttccgcgacctcgtgcgcagggcgcgcatcactttcgaatgcctccgcgggcttctactcagggacgacgagcgcgccgagtccctcggccttgcggccgtcgccgggttcggcgttgccagggaccggcgccgcgtccgcgcggacctgcgtgccgcagcgctcatgggggaccacgacctctggctcaatcgcgaccgccgcatcgtcgggccgatgcccgggatctcggtgggtgacgctttcttcttccgcatggagctttgcgtgcttggactccatggccaggtgcaggccggaattgattatgtcagtgcagggaggtctgcatctggggagcctatagccacatctataattgtatctggtgggtatgaggatgatgatgatcacggcgatgtacttgtgtacactgggcatggcggccgtgatcccaacctccacaagcattgcgtcgatcagaagctggagggcggcaatcttgccctcgagcgcagcatggcttatggtattgagattcgtgtaatccgtgctgtcaagtcaagacgaagccctgttggtaaggtttacttctacgatggcctctacaaggttgttgactactggctcgaccgtgggaaatctgggtttggtgtttataagtatagactgctgcggattgagggccaagaacccatgggtagtgtgaattatcgagtagctgaacagcttaaggtggatgtgtttgctataaggccaacagggtatttgagctttgatatctccatgggccgtgataccttgtcagttgcactcttcaatgatgttgatgatgatcaggacccactcttattcgaatatctggcacgtccaatatttcctacctctgctgtccaggggaagtttgctgaaggtggtggtggtggttgtgattgtgctgagatttgctcaattggatgtaactgtgcagggaggaatggtggcgagtttgcatatgataggactggaaccctgctacgaggcaagccactggtatatgagtgtgggccatactgcagatgcccacctagttgccccaacagggttagtcagaaggggcttcaacataggcttgaggtattccggtcaagggagactgggtggggagttcggtctttggatctcattaaggctggcacattcatttgtgagttcagcgggattatccttactcaccagcagtcagaggttgtggcagcaaacggcgattgcttggtgcgtccaagtaggtttcctccaaggtggttggattggggtgatatatctgatgtctaccctgattatgtggcgccagaccatccttctattcctgagttaaaatttgcaattgatgtgtcaagggcaaggaatgtggcatgctatttcagccacagttgcagtccaaacgtgtttgtccagtttgtgctgtttgatcattacaatgtgtcttacccccacctcatgatctttgccatggaaaacattccaccgttgagggagctaagcattgactatgggatggttgacgaatggattggacagttaactatgtagctggagtatctatttagaaggcagtaatctccttcttttacctttatttttgaagttttcattatgcttcactttgggatcatcaagccaactgctggctaaaattcctcagctggtaattgtccttattcttcatatgctattttttgggtacttcataggactttcttggcagtaggtgctcataattttccttaaaggttgctttgtgtatgtcactgagtttcatgtgtactttaaattttatattttgctatactgtatacttctgcgcagatctagactaattatactatctagctatcctcctaatttctctacctcattgctgattcagtgctttggttaaataaatctatactgtagttgcagaagaggttgtatgtcacccatttggtaaaccgtatagtgcacatgatcctcagctgtggcccatggcccttactagttatgtctatacactgcatcctaggaaaatctaaatagtcactttattctttttccagtaaggaagatgatgattttattgcataaccattaggtgaccatctctagtccatttccatgttggtcaacatctctgttttgtggtgaataggacagcagtagcagtggacagcagcagcagcagcaacagtcttttgactgctgtaggacagcagcagcagcagtcttttgactgcactttattatctagagaacaacacctgtgtgctgcagtgtgtagtgtagtgtgtagtgcagcccctagggctataaatatgtgtccccaactcttctaagggtatgacattgtgtagtatttgagaaaataaacagaaaatcgcctcaactcatagtgtcatcctctcgatgagagtaagagtcctgttgcttataattggcattagagggaggttgtcttgcagcctaaacatctcttgctcatctccttcccgcgcctctctctatacttagccggcagcaagagctccaactgttccttcctctcctgctcggacgagcagccgttcatctgagagagcctattccacacgcaacgacccctcgctagcacatcatgtctctacactcgatcacttcgagtgcgtggcgccagcaggagcccaaggtcgccgcagcacaagaacacgagcgagcagcgacagcggcgagggtggcacgactagcggttgcggaactggcagcaacgagagcggaagtagaagcagcagaggcagagacagagctcgaggctgagtagcgccggcagctctgtttccggcgatggcaacaccaacaacgagctaaggatggcaagggatgcagcgcaagagcagacgactcaatgggcagccatgcacccccatgagggcgcacgcggcgacagcctagataggcgcagacgcgccgacagtgctccgggcgagaatgcacgcggcgacagctcagatgggcgcagacgcgccgactgtgctcccggtggtggcggccgggtccatggagatcgcggcctctacaggcggcgcgactctccctccccggatcgataccatggtcaccgtggggtccatgccgttgtcagggacatcggtcccggcggtgggtggcctactctcaccaagaccaactacgtcgagtgggccgcagtgataagggtacggctccaggttcgccacatgtgggaagcagttcggtatgacgacgtcgactactacgaggatcgacgggcactagatgccctcattgctgtagtcccgcccgagatgcatttttcgctttcccagaagcggactgccaaggaagcctgggacgccatcgtagcgatccgcattggcagcgaccgtgcccgcaagaagaggggtatcgatgggcaggaacgccggccgggggcctctgcccacggccgagcaagaggagggtttctcccttctaattcttgcctactttatttctcattcattgattacataaataggccagctggccgtccctatctagctagagatccttatctccttaaaactctcctaaaaactctcaacaactactaattgataacgttcctagataatctcaactaatctcctagataatctcaactaatcttgtctctaactatccttatctaatcctccttagagggtccatcgctgctgctaccgcagctcctccgtgggcctccttaggccctgacactacacccctcctggacaagcagctcgtcctcgagctgcagcatgacgagtgctcaaataccgagtctacttgacctaaaaccagacacctagaagacaagccttttacatctcggcttatcttattattccgaatctgaattttttttttaccccataagataaggcgaacaccctccgcgcattggacttgtacgtgtgcagccacctggatcccatggacgccatcttgacgaaaggggagcacatggacgggcacctggaataggttgcaacaataaccagcgaaggcgccctcgtggcggccggtagcggaatgtggtggcgctaaatagtgcgcccttgccgatgacgaggggagtgccttccttaccgccactgccgtagagttgaagttcgtcgcccgcgggacacgtaccatgctcgcacttggagatagcggcccgatgccgctgctgatggccgtccgacagggtgaggtcgcgcccccgtgtgccgaggtcaaccgtgaccaaggctgcctcgagcatctgccgacgcatctcccgcgctctccgtcgtgcaaggaagccacgagcagcagcttgtatgcccacagccgccgacgtctggagccgtgcggacaacgccaaccggtgctgctcatgttgcactgctaccttgatttgcagcagcccttgctcaaccttctggagcgtggcttgcatctttgcgagatcagcccttacgttggtccacaagtcccccatcgatggagctggtgattgatgagctgtggctgcccctagtggcgtcacccatggggacggagatgccgtcaacgaagatgatgtgacaaaatttggcgttgtccctggagatgggcacgccggcgtccaggatgtggtgacaaaattggcaggcgatgctgcccatggagatggggacgccggttgccaggatggtgtgacgaaggtggcatacggcgtagcccatggagatggggacgtcggttgccaggacggcatgacgaaggtgacatgcggcgcagcccatggagatggtgacgtcggttgccaggatgacgcagcaaaattggcagcagaagccatgggatcagatcgaaacccaagctagccgataccagatgttatggtcgctagatcggtgagggattggagaggggtatcgatgggcaggaacgtcggccgggggcctctgcccacggccgagcaagaggagggtttgtcccttctaattcttgcctactttatttctcattcattgattacataaataggccagctggccgtccctatctagctagagatccttatctccttaaaactctcctaaaaactctcaacaactactaactgataaccttcctagataatctcaactaatctcctagataatctcaactaatcttatctctaactatccttatctaatcctccttagagggcccatcgctgctgctaccgcagcccctccatgggcctccttaggccctgacactacacccctcctggacaagcagctcgtcctcgagctgcagcatgacgggtcctcaaagaccgagtctacttgacccaaaaccagacacctagaagacaaaccttttacatctcggcttatcttattattccgaatctgatttttttaccctccgcgcattggacttgcatgtgtgcagccacctggatcccatggacgccatctagacgaaaggggagcacatggacgggcacctggcgtaggtcgcaacaataaccagcggaggcgccctcgtggcggacggtagcggaatgtggtggcgctaaatagtgcgcccttgccgatgacgagaggagtgccttccctactgccgctgtcgtagagttgaagttcgtcgcccgcgggacacataccatgctcgcacttggagatagcggcctggtgccactgttgatggccgtccgacagggtgaggtcgcgtcgacgtgtgccgaggtcaaccgtcaccaaggctgcctcaagcatctgccggcgcatctcccgcactttctgtcgtgcaaggaagccacgagcagcagcttgtatgcccacagccgccgacgcccggagccgtgtggacatcgccagctggtgttgctcatgttgcactgctgccttgatttgcagcatcccttgctcaaccttctggagcgtggcttgcatctttgtgagatcagcccttatgttggtccacaaatctcccatcgatggagctggtgattgttgagtcgtggctgcccctagtggcgtcgcccatggggacggagacgccgtcaacgaagatgatgtgatgaaatttggcgttgtccctggggatgggcacgctggcgtccaggatgtggtgacaaaattggcaggcgatgctacccatggagatagggacgctggttgccaggatggcgtgacgaaggtggcatgcggcgcaacccatcgagatggggacgtcggttgccaggacgatgtgacgaaggtgacatgcagcgttgtccatgaagatggggacgccgattgccaggatgacaccgcgaaattgggagcagaagccatgggatcagatcgaaacccaagctagccgataccagatgttatggtcgctagatcggtgagggattggagagggaattcgatggttggggatgctggtggaggtggtgcggtactgttcatgcgtgaacagtactcgcggatgttatggtcgctagatcggtgagggattggagagggaattcgatggttggggatgctggtggaggtggtgcggtactgttcatgcgtgaacagtactcgcggttactgttcacaggacaccggccgggggtctctgcccgcggccgagcaagagggggggggtttcccttctaattcttgcttactttatttctcattcattgattacataaataggccagctggccgtccctatctagctagagatccttatctccttaaaactctcctaaaaactctcaacaactactaactgataaccttcctagataatctcaactaatctcctagataatctcaactaatcttatctctaactatccttatctaatcctccttagagggcccatcgctgctgctaccgcagcccctccatgggcctccttaggccctgacaatgaccttcaagccaggtgaggatgttgatgactttgctcttcgcctcaacactgtgttgcagaagatggtacagttcggcgatgacacctacgatgaggagagagccgtcgagaagctcttccgttgcaaccccgagaagtacaagcagatcgctcgctcaatcgagtctctgctagacctctccacgatgacgattaaagaagcgattggtcgggtccggcgtctcgcattctggcgggagagttgcatcttgcatgcggcgatggcgagcctcggtcttttgcggaggctgagaaacacgcgtcttagcgtgtcgcgatgcagtcggagatgggcgcggttgagacgaaccgcacctgggagctcgctgatctccctcatggtcatcgtgcgatcacccttaagtgggtgttcaaactgaagagggatgaagccggcgccatcgtcaagcataaggctcgcttggtggcacacgatttcttacagtagtaggggatcgacttcgacgatgctttcgcccccgtggcacgatggaatccgtgtgactccttgcgctgttagccctggagggttggcacgttcatcacatggacgtcaagtctgtgtttcttaacgacgacttaaaggaggaggtctacgtacacggtccgccaggatttacgatccctggcaaggagggcaaggtgttgtgcatgcgctccctctatggcttgcgacaggccccgagggcgtggaatgccaagctggattccacgctcaagaggatgggcttcatgccaagcccgcacgaagcggccatctatcggcggtgcaatggagaaaatgccctgctggtgggtgtctacgtcgacgatttggtgatcatcggcgccaaggatgcagaggtggtggcgtttaaggaagagatgaaggcaaccttcttgatgagtgacctggggcatctctccttctacctggggattgaggtgcaccagagtgactctgggatcacacttcgtcagaccgcctacgccaagcgcatttttgagctggctgggctcactaattgcaatccaactctcactctgatggaggagaggatgaagctgatccgtgacagcatgacagaggaggtagacactactcaataccggcgtcttgtggggagccttcgctacctcgtccacacacaaccagatcttgcaatgctccgtcggctacgttagtcggttcctacaacgatcgacgatggagcacgagcaggctgtgaagaggatcgtccgctatgttgcagggactcttgaccacggtctctactactcgaggtgccctggggaggcacaccttgtcgggtacaggtacagcgacaacgaccacgctggcgacatcgacactagcaaaagcacaagcgggatcctcttcttcctcggcaagtgcgccattagctggcagtcggtcaagcaacaggtggtggccatgtacagctgcgaggctgagtacatagcggcctccaccgcttcaactcaagcactctggctggctagattgctcggtgatctcttcgggagagacacgacatcggtggaactcagggtggacaaccagtctgcattggcgtggccaagaaccccgtgttccacgaacggagcaagcacatccgggtgaggtaccacttcatccgtgactgtttggcagaagggagcatcaaggcgcgctacatcaacaccaaggatcagcttgcagacttgctcaccaagccccttgggagaatcaagttccttgagctttgttccagatccgagatggttgaactttcccacaagacgacacacaagacttagggagagaatgatggaataagtcatgtggtcttcgtgtgcaggacaacatctatgttttgtggtgaataggacagcagtaacagtggataacagcagcagtcctttgactgctgtaggacagcagcagtggacaacaacagtagtcttttgactgctgtaggacagcagcagcagtattttgactgctgcaggacagcagtagcagcagtcttttgattgctgtaggacatcagcagtagcagtcttttgactgcactttagtatctagaggacaacacttgtgtgttgtagtgtgtagtctagtgtgtagtgcagcccctagggctataaatatgtgtccccaacccttctaagggtatgacattgtgtagaatttaagaaaataaacagaaaatcgctccaactcttagtgtcatcctctcgatgagagtaagagtcccgttgcttacagaggataccattgtagctgtttagtttgaactaccagatcctatgagacaaggtttcatcaagattatgtgtggtagcaaagattgatgtctggtgcactatacaagaattcttgtagcaaactcatgtgtttgaaacttagaatcctattacactaagtttgtagtcctgatcattaaaagattcaatgatgagcatattgggcttatgaagtttggcagtcttaattgtatgaatgttgaatgcctggctccttaaaattgcagctttggccaccagcccaccaaaacatctaaatggtgagctgtcactaatggagtagtgttaagagtatgttttttcctgttgggcataggccttgtatacaaggggtgctactatatgtatgccacatgtacttgttaatgcaattaatctattctcctccaatattgtattggagttctttcctgccctagccgctagctacaaccctagttgctgactctctctctccccacctctcttctcggccaccgctagccatggctggctgcctgccacctcatcgccccggtgtggtcttcccccaccccggtgcggcctttccccctctctcctccccttctctactagccgtagcctgtccagccgccgttgggtcctgggtggctgtcttggccctcgtcctcgatgccggcgactcggccagccctggcgcgggtttgttggccatcacagcctcccctcccgccctcgccctgtccaacatcatcgggccttgggtggctaccttggcccttgtcttcgtcggtggcggctcaacaagcccttgcgtgggtctgtcggccaccggctcgggcacctacctcgtctagcaccagcagacaaagcatgtcgagatcgacctccatttcgtctgcgaacgcgtcgccattgatggatgatgatgttcgtgtctcctggtcgtcaaagcggcaacatgttgtctcctgctcgagtgtcgaggccaagtaccatgccgtggctaacggtgtggctgagacatgctagtttcggcagctccttttggagcttcacagccctatctacagtagcaccctcatctaccgcgacaatgtcattgtagtttttctctccaccaatctcgtctagcaccagcggacaaatcatgtcgagatcgacctccatttcgtctatgagcgcgtcaccatcggtgatgtttgcgtccttcatgttccgacgactactcagttcgttgacatcttcactaagggcctacctatgtcggtgttctcagagtttcactccaagtctcaacatctgttgttgctagagtttcgattctgggggtgttagagtatgtttttcgcttttgggcctagtccttgtatacagtccattaggggtgctactacatgtatcccacatgtattggttaatgcaattattctattctcctccaataagtaggtgccttgtgctgctgactgtgcaaaatctttgatatgtctagacatcactggtttagtggttcctgttatgtatgcatgctataatagaatacttcataaacaaaacatctgttgtatgtggtcagcgggcattaaaatcatgttgaccaagcttcagatatttctgtggcaaactattgaatagagtgaccctttttcctgttttgttggtttagacccaaaccaatatctttcactgatttgaagtctctttctagctattctatgtccaactgctctttgttcctccactcattatcacaaatgatcagttgttccctgtgtatgccattgtcacttgtacatttttgaaacagacattttgctcattgctctattatatttgtgcaagtattttgcatgtggttttcacaaaaaattattgtggttcatatgctatgcagtgatagttattaactgtttacctactttcatatttgcctcaatttgttatggtttcaaatttagtgcatacaaaagttttggatagttataactcaattttttgtcagatttatctgatagctaaaacttttatttgtttttataatatggaagagacatcttgtacatctatgcatgaaaactgataattaacataagcatgcaggagactgcttcatagcctgtagaaatattttttgtaaattttgggtagcaaatatcatgagttagcacacgtgacttttactgtgaatttattattgatttgtgttatttggcttttattctagtttgcagtcacacatgtgcctcttttggttttcttttattcagttgagtgtatttctacatacctgatgtgaacttacaattgtccaagccatgatgatttatgcataaatctaattagctgtgcacattattactttgtacttttcctgtatttttgcacttacatatcggttcttagcgtaatattgtactattttattttttttcttaagtcatttgatccactttagattcagatcctcttgtctttttttgcatgcttgatcccaccccaactcgtgttggtccggaatatgctgattgcgtgatgtatatgattttagaatgaaaccctgtgcatcgttaagtgtttttttctatgcttgcataatttacttgagtaacagttttcccctgtttcctaagttttagctaactacacaaatgtggttgatcttggttgtttaattactagtcttttagaagtcctaaatttatggtatccttgtttcagtccagcagtggaggtttccaactagcataatgttcctctggcgttgaaagaggcttgcataaggtgaccaagctatcatcaacagaacatcagccgttcattgtatatgttgcctgataacctaggtgccttagccaattttctagatgatctcgcttttgaagtataatgtgtgctgctgtaggaagcttgtttggcgtggctggcgctgagtttcagccttaaccttcgtgttatgagttgtcgctgttggaactcattttctgtacatatatctgtaaattatctagctggaaatgtgcccgcttctgttgggaaatgttggtccatatgtggcaaagttatttggataccttgtggaattgaagattccgcggagccaggtttgtccgtaggtcattgcattaatgattttgtgaaattatttgtggtgaa

SEQ ID NO: 701 - DNA, 3995 bp, Zea mays
ggggtgtcttctgatgtcatcaatccagatcgcttcattgcttcagagataggaacagtttccgcaccttcggcttcgtcccctcgcgctcaactctagcagtagagcgcactctggccatttaattttgaatttcttgaaaaatttcttagaaaataataaccttctcttccgaagctattcttctgacgaagcaaacaccaaattggagcttcgtttgaatgcgaaaatcaagcttcggctatggttaaaaattttggcagcaaaacagtgcaatagcaatgaatgctgtggtaacttcacacctactcgtctgtttatatagtgctgcaggtaagaaggtgaatcgtcaggatttttacaccaggcaaacagttgctcgcacccgctgaatggtgggccgcaaaaatcagaacagtgaacctgcatggtgggaccgctacacgctcgaaagatgtatcgtttctcgacaacgagctcaggaaaggtgttttttggaccttcggcttcctgaagcctaagagacttttttcacggatcaagctcgttacgaaaaacgatctagcaccgcgaaggggctactgttgggaccatgcttcgtcgccgaaggtcctgcaaaaagaaacagtttcaactgaagctgcttgaacatgatgccgaagacaccgttcacgaagcttcagagctacaacatatacgaagacgaagggttgaaccgacttaaagataaaatgaccttttagccttcaaaggtctgagtcattgttgtaaacttttatgaggggcataattgtaattcctcatgggctgtgtcctgtgcctataaatagtgaacaatattcctttactgttcacgcattcctgtaattgctaacgcatcactcgggaattattgtttgtcaaggcaaaggtataaatgtacctaattgttgtattcaaatatcttaaattcatataataagatatgtgaatgatgtcatttattttcaatgtatttacctttagtgtcccatgttttattttactttgtattatccttataagtttaattacgaagatgaaaccttcgtaatattatgttcgtgaccttcgtccgaagttcattaaatccttgtggagataatgtttcggcggacgaataatattaatatttaacattttatgttgtcttgttcttaattcatagcattcaagaacaagtccccaacaatccgtcttctaaattctaggcccggcactgtctcaagtagaggtttttgtgtggattctattcgtacttttagtcgcctcagcggaaagaaacaaatctatatattttatgtagtagagaagaagaaaaatagaagagaagattttttggttgtccttatctatttgttaggcgagaagtaagagaaaataatgtacctacgtgttttgttcgtgaagtatggataccaagtaccaacggtagaaaattatttataggagtgagattccgttggagctcgtctggaggacgctctattttggggagattttgcaacctctccctgactgcgccatttttttttctcgcctccaccaacgtcagctctccagtcaccagttggacaagcgggacgggacaacatcctcaccagccgcaatcctccactcctccccgcagccctcgaccctcgtcagcctctccagttcacctcgccgtctccgtcatgccccgcgagggtttggggaattttggagcggaggaggaggcgagggatggtggacaggaaggtttggttacggaaatggatgtggaggaatcctcgccgtcttcgtcgccgatgtcgtctccggccgggtcgtcagattccatagacctcaacttcctgccgtttctcaagagggagcccaaatcggagccgtcgtcaccagagctcgggcccctgccgctgcctgtctccctcacccagacgccgccgcagcagcatgcagcggcggcggctccagcaactgaggcctcggtgcctccgcctccggcgactcctgacctctcgtccgcgtcgatgatgaccccgctgcagtcgctgccgcctaacccagacgaggactcgctccttcgggagtactaccgccttgcgagactatatctctcgtctgcggggtccggggcgatcgtcccgacaccggcaccggaggcggccgcaccggcggtggtacagtccggggccgggtccgtcgtgaaaaagcgccggccgcggtcatcggagctcgtgcgggtctcctcgctcggtgtgcaggatcagatctacttccgcgacctcgtgcgccgggcgcgcatcactttcgagtgcctccgcgggctgctactcagggacgacgagcgtgctgagtccctcggcctcgctggtgccgccgggtttggcgttgccagggaccggcgccgcgcccgcgcagacatgcgtgccgcagcgctcatggcagaccacgacctctggctcaatcgcgaccgccgcatcgtggggccgatgcctgggatctcggttggtgacgctttcttcttccgcatggagctctgcgtgcttggcctccatggccaggtacaggcaggaattgattatgtcagtgcagggaggtcggcctctggggagcctatagccacatctataattgtatctggtgggtatgaggatgatgacgatcatggcgacgtacttgtgtacactgggcatggcggccgggatcccaacctccacaagcattgcgtcgatcagaagctggagggtggcaatcttgccctcgagcgcagcatggcttatggtattgagattcgtgtaatccgtgccgtcaaatcaagacgaagccctattggtaaggtatacttctatgatggcctctacaaagttgttgactactggctcgaccgtgggaaatctgggtttggtgtttataagtataaaatgctgcgcattgagggccaagaacccatgggtactgtgaattatcgagcagctgaacaacttaaggtggatgtgtttgctgtaaggccaacaggttatttcagctttgatatctccatgggccgagagaccttgccagttgcactctataatgatgttgacgatgatcaggacccactcttatttgagtatctaacacggccaatttttcctacctctgctgtccaggggaaatttgctgagggtggtggtggtggtggttgtgattgtgctgagatttgctcaattggatgtaactgtgcaggaaggaatggtggcgagtttgcatataataagactggaaccctgctacgaggcaagccactagtatatgagtgtgggccatattgcaggtgcccacctagttgtcctaacagggttagtcagaaggggcttcaacataggcttgaggtattccggtcaagggagactgggtggggagttcgttctttggatctcattaaggctggcacattcatttgtgagttcagtgggattgtccttactcaccagcagtcagaggtcatggcagcgaatggtgattgcttggtgcgtccaaataggttccctccaaggtggttggattggggtgatatatctgatgtgtaccctgattatgtggcgccagaccatcctgttattcctgagttaaactttgcaattgacgtgtcaagggcaaggaatgtggcatgctatttcagccacagttgcagtccaaacgtgtttatccagtttgtgctgtttgatcattacaatgtgtcttacccccacctaatgatctttgccatggaaaacattccaccattgagggaactaagcatcgactatgggatggttgatgaatggactggacaattaaccatgtagctggagtaacctatttaaaaggcagtgttctctttctttcttttccctttatttttggaattctcataatgcttcacctggggatcatcaagccaactggactaaaattcctcagctggtaattctccttattcctcatgtgctatttttctttgggtacttcat

SEQ ID NO: 702 - DNA, 8319 bp, Zea mays
cctcggcacgcgcgcccgtgccgcccccggcgggcatgcgacgtcctgccctgcccggccgcgcgcacgccgctgcaatgcaatgcaagcaagcctgctgctgtctgcggcggcacgttctgtacgcatgctcaggctcagctcgtaggcgtgtgagtagacgtggctacgaggaactagggcctgcggtgcttgttgctgctggactggaccgccgcgccctctgtgcttgccgctgcctggcagaagcgaacacgggcgggcgggggcggccgtgattaaaaacgggtttcacccatgagggactggccggtggccgccagtggcttgtgcggcgatgccggcgagtctgttctgcgatagtgttggagcgccttcttgtcggggggggggggggggggggcacgcttccaaatcgcgagcgcggccgtcgaggcggctagcttgctctcgctcgtctctctggcgttttgctgcgttttctccgctttgttttgccaaacctagaggctcgtgccggtgcttgtctggactctggaccatgctggtgacctaatagtagtactgtataggtaattaggtatagacaaacggtaaagtccatgtgaagaagtttcaccttcaatttggctcttctcttcgatttggcttcctatttgttttttcccctccaactcgaacggaccgcactgtggtagtagatgttttgccccccaacacaatgtgcatctgttctgtgtccagtgtggtgtcacaagaaaatcgtgacagtgtcctgcagaggcctggccccgcccggctcggcctcggctcacagtttatatacactgctttcgagagtgatgcatgcatgcatgagacccattctcgagccgtagtagcatctggactacttaggtgctagtaccagcagtagtagcggattattctgcacttgttttgtcaccatccacagattaataaaaaaaacattccgaacacatactacgcagcgagctgcgtgcgatggagtgccgccacgcttttctataaaaatccccatccattcttccccctggaaacacaccaaccgaagcccatccatccactgtctcgtctctcgtgcgtgcgtgccccggctcgttttccacggcttttttacgggccgcgccatcaccatgcatggcttgcctgccgctgccgcccgcgctagtggacctccagcacaatccccggttctccgacgcctgccacctttgttggtaaaaaacagtgaggacgtcgctgccgcttccgtcatgactgttcaccagactatgaccgttcacagactaccctacccctccccctccctcggccggtcccgttcccgcgccgcccgccggccgcccagtccctagcatagcaggccaaacctgcctccgcgcagttgctgccgcgtcaatgctgccgtgccgctggagagagagagagagaggttcttctaatgcccttctgttctgtcccgcccccgcgccgcatttttttttcatttttttttaccttgcgtgacgcttcgttttcacagtgcggcggcggcggctgcttggctcgttgctcctcccattctgctcagctcagcttctgatgagttcgcctttgccgctgctagttaccagcatactagaccactgactgatcacgttataaggcttccgcgcaggcgagcttctgccgccttgtcgggtaaccaaacggacctcgccggccctctccagtggtcacatcacatcacatcacatgctcgaggtcgtcctggacatgacgccgccgccgccgccgccgcaggcgcggctccaccaggggtcatcagccaagggcgggcacgcggagcggaggaagcaaccgctgcagagcagcgtgacacagcccaaggcagagcccgcggcggcggcggccgtgctgccggtgccggagggaggcaagaggtgcagagggggcgggaggcgccgcggcagggccaaggcgcccggtgagcctcgcgccgcgctactagcgccagcgcaggcgcagacgcaggcgcctccgccgcgcacggtcattgggccgcccgtgccgagcaaggggctgtcattctgccgccggccagggttcgggacggtgggcgcgcgctgcgtcgtcaaggccaaccacttcctcgccgagctcccggacaaggacctcacccagtacgatgtaagtgctcgccgcccattccacctcgctggccttgaggaccgccagcgctgcgcaattgagatcaaaaggcgacgcttttatttgttttcttttttccacgcgtggttttgcaggtgaagatcacgccggaggtgagctcgcggaccgtgaaccgggccataatggcggagctggtccgcctctaccgcgcgtccgacctggggatgcgactcccggcctacgacggccgcaagaacctctacaccgccgggacactaccgttcgacgctcgcgagttcgtcgtgcgcctcgccgatgaggacgacggctccggcgtcccgcctcggtacgtgcctccgcctgcatttgtttcttgcgccactcgggccgcctgagcctccttgtacgtctttcttaacggcatgccgccgtactgattcgcgtgattgccctaccccccagggagagggagtacagggtcgccatcaagttcgccgcgcgcgccgacctccaccacctcaggcagttcatcgccgggcggcaggcggacgcgccgcaggaggccctacaggtactcgacatcgtgctccgcgagctcgccaaccagaggtatttattccattggcgcctgcattgactgcaacgttgcccgtttccattcttgaatttgaggaagcgcttcttctcccccacgttggttaggtacgtgtccatagggcggtccttctactcgccggacatcaggaagccgcagcggctcggcgacggcctgcagtcgtggcgtgggttctaccagagcatccggccgacccagatgggattgtcgcttaacatcggtgagttattgtgccgtgcctgtggttggggaatatttgttgccctcatgcatgcgatttcttttttgtcccgtggctgctgcttacacggcgatgttgacggcagacatgtcgtccacggcatttattgaacccctgccggtgatcgagttcgtggcccagatattaggaaaggatgtcatatcaaggccattgtccgatgctaaccgaatcaaggtaatattactgtggttgcgcaaggactctagcatagtactacacgaatactccctccgtttctttttattagtcgctggatagtgtaaaattacactatgcagcgactaataaaaagaaacggagggagtatataacagctgccattgggcgctagtattgcttatggattaatatttatcttgtgtaattcgcttattttgccaatcagatcaagaaggcattgcggggtgtaaaagttgaggtcactcaccgggggaatgtacggcgcaagtatcgcatttcaggcctcacaacacagccaactcatgaattgatgtatgtttagattctgaatgatttttactagttcctgaagtgctgttgttgtcatctctcttcccagtggtggatctagatttttttttggtgtggggggagggctgcacctaaaagagcaagaccaacttaactcagctatatcccatacaaaattagcatatagctgttttaagcattttggccctgtttggcacaacttattttcagcttcttcatagatttaagtagaagatgtgctaaacagtcagcttctccagcagcttatcagttcagctgattcttaaaatgaactaaaagcagaagctgtttttcaaaagcttatcagctgtgccaaacaggcctttacacaataacttggataaacaattgaaaaccctggtggtaaatctgcccgactctttcgatacatgatgtagcctgatttgatgagcataaaacagtggtaatatgttgacacaaaaaggcggctatactcaacttgtgcttacattattaattacattgattatctaattcaccttagcagtgaatacattcgacaaataaaatatgtgatggtgaaaggttgttgaacattgatgcctaaatcagttgatcgttttttttcctgtttttcacagtttcccgattgatgaacaaatgaatatgaaatctgtcgtggaatacttcaaggaaatgtatggtttcaccattcagcatcctcatcttccctgccttcaggttggaaaccaaaagaaggcaaactatctacccatggaggtcagtatatatgctaatcacaaacttatgttgcttatcaattctgtttatgtttctggttagtgttagactctaataatgtatcgttgtaatgtcgaggttttttaccaggcctgcaagatcattgaaggccagagatacacaaagaggctgaatgaaaaacagatcacatcgctgctaaaggttacatgccaaaggcctagagagcaagagatggatattctacaggtcgagagtttttgttgtaaccagtaaccctattattaaagaagtaacttttgaacacaacattctgtatgttgagctagagttttattgtaggtaaaatgaattatctctcttgaactaatggtacatattatgtgtggagctaaatgttctatcattcaaggtttttttgttcatgaactaatcggaacattgcgagaagacatgcattataactgttcattgtcctatcctagagtactgcatttattttccagtggtccatgctttccatgcagtgggcctttaatagacagccataaatacagctaggatttttcactttttataagtgatggttttaattaatcaaaagatttgttaaaatggctcaagaaacaacattatttgttttcagacagttcatcaaaatgattatgagcaagatccatatgcgaaggaatttgggatcaacattagtgagaagctaacctctgttgaagcccgagtccttcctgcaccttgggtaagaataattttatgtcacttttttcctttcaggagcaccttacactattatccatgaggttagttgctcattgttgatgcatcgaacaatttttttgaattcagttgaagtatcatgacactggaaaagagaaagagtgcttaccacaggttggtcagtggaacatggtaaacaaggtaaaattccagcttgtgtgtaattactatgtttgattgcaatacttttgggcctaaaaaaatcattttacagaaagtgataaatggatgcaaggtgagccattgggcatgtataaacttctcaaggagtgttccagaaaccacagctcggggattttgccaggaattggcacaaatgtgtcaaatttcgggcatggtatgatacctctcatctgtgctcatgtttgtgcacaagacaaaaacttgtttaaattgaaactgtaagcatcttttaatttgacttcctaagtattacaggaatttaacagtgagcctgtgatgccaatatattcagctagaccagatcaagttgtgaaggcacttaaaaacgtgtataatattgcattgaacaaacttaagggtaaagatcttgaacttcttttggctatcctccctgacaacaatgggcagttatatggtaagtgccatctgctaattgctttgaatatataattacttcaactcttacatattttatcagatataactttatatatatttaaagcgatataacttcatatgtgtaggtgacatcaaacgtatttgtgaaactgatttggggttgatatcacaatgttgcttaaccaagcatgtttttaagatcagcaagcagtacttggcaaatgtctcactgaaaattaatgttaaggtacttaccaccttgtttatacataaaatacagtttagaacatcaactatataagtggctctattattgactaatggtaccaataaaattcagatgggaggaagaaacactgtgctcctggacgcaataagttggaggattccgttggtcagtgacatcccaactattatatttggtgcagatgtaacacatcctgaaaccggggaggactcaagtccatcgattgctgccgtaaggctcgttactactttgccatttcttcatcaatatgtcacattcatcaggatatgcacatccttatttttgttccgaacttatctgtctgcctctttctgctcacaggttgttgcttctcaagattggccagaagttacaaagtatgctggattggtttgtgctcaggcacaccggcaagagctcattcaagacctttacaaaacatggcacgatcctcagagaggcactgtaacaggcggcatgatcaggtttttatctacgagcaatgtgaaatcctgaagtgcaatatacaatttaatctattaaaaatattggttgatttgaacttattttctgtgatgtttgttgtgtagggagctcttaatatccttcaggaaggccactggacagaagccattgagaataatattctacaggtatggttgtgtaaatgttgacatcacctgtagcttgcagatggcaataataaaacatatctgatgcctactattgccatgtgaaaattttctacgttagggtgtaggttagtgatgtatcacatgtcttctttatgttgtaactaaactattattttccttgcaaaactaaatgatgcatatgctaaatttgttgaattttctttcagggacggtgttagtgaaggtcagttctatcaagttctcctttacgagttagatgccatccggaaggttgggtgcattttaatgtttttttattcttctaagctccttatagtttactaactagcgtttttttccaggcatgtgcatccctagaaccaaattaccagcctcctgtaacatttgtggtggttcaaaaacgtcatcatacaagactatttgcaaataatcacaaagacagaagtagcatggacaagagtggaaatattttgccaggtagtgtatctacggcctctaaatctttaggatgtgtatctatgaccacattatttcaagtgacatattccaaactttattagtactcgaactcaaaatgtattatgttttggagtaaaaaaatattgtctaattttaagatgttaagaaattagccactcttttgaggcagccagatttttcttttgtttaaatcgcattacattgaagcaagatgtaacaccctacatttttcttttgactgctcacaagttgattgaaacaggaaccgttgttgattctaagatatgccacccaacggagtttgatttctacctctgtagtcatgctggaatccaggtaaaagtaatgtggatttgtggaagaccgatattactttgtgcaatcctgacattacatgttagctggaatattctaccgtacctgtcatttgtgagtgaccaatagtatcgaaaagactaagaatacaaacttatcctatttggtcaaccttttaatcatgtgattgtacagcttatggtacttggatcagtagcatgggaatgtagtcagactctccgtactatactggaatgactgatgtgtgagtttgccagggaacgagtaggcctgctcactaccatgtcctctgggatgagaacaatttcacagcagacgaaatgcagacattgacaaacaacctttgctacacgtaatgcacttcttttatatgctatgtttgtcccttgcactttgaactttgaactttttgagaattttcttagattgatgtatactgatgcagttatgcccggtgcacacgctcggtttctgttggtatgttctgtgctttacaggcaaatgttttcccagttccacaattcttaattgactctttagcctgctcaccagttcaggaaacaactttgacctgtgatgttgtatctttttgcttcttaacagtccctcctgcatactacgcacacttggcagcattccgggctcggttctacatggaaccagagatgttggacaaccagacgtccaagacctccaatggcacgagcggagtctcggtgaagcccctgcctgctgtgaaggagaaggtgaaaaggatgatgttctactgctgacaaggagaccacttaaccactcacatgctgtagctaacttgctagagtttagtaaggattagatagctttctcaaggagtgatggatcaatctgatctgttaacgacctctgtaaagtactcggaaatggctgtataatagttgttgtttcaaatgtgaaagcatct

SEQ ID NO: 703 - DNA, 7402 bp, Zea mays
cctgcctgctggaccactgccagccagccagccagccgtgcccactgacggccggacgcgattagggcactcttcgttttgtcacttaaaaaaagagaacggttttcagtcgtcgtggttgcccggggttctgcggcgattctatctattctgcgctagtggagcgccttctcttgtcggtggcacgcttccaaagcgcgagagagcgcggccgccgaggcggctagcccccgctctcgctcaggctctcagctctgccgctttgctttgctttgttaatggccttttttctataacccatatggaccatgctgcgcggattaaagaaacccaaatagcatagacacaagcggtaaagtccatgtgaggaagtttcatctcaccgtggtatgtatctcttcggtttcgggtccggaacactgcatattttattttattttattttatttttctgtggctttctattgggcttttctttctccctccccccgaaccgaatggactggaccacattgtggtagtagctgtttccggcaacaaaacggtgcatttgcactgtgtcctgcagatgggaccggctcacagtctatgctactgccgctcgtatttcgagagcgatgaaacccccatcttgagcctagtgctcgtgtgtgccagcactagtagcggattattctgcacttgttgtcacgatccacgccttaataacattcctgacaccacggagcgagctatcggccaaccacacgaacatgcgcctacgccttttcaatagaaaaatccccatccacccccatggaaagcaccatccgaagccactgtctcgtgcgtgccccgagctcgttttgctcggcttttttttttaccggccgcgccccatcaccatgccatggcggctgccactagtggagctccagcacaatccccgcttctccgacgcctgccacctttggtaaaaacaggaggattcaatttcaatggctgtcgctgccatgtgttttcacaggccctgacctaggctctgagagaggagagagagagagaggaatttaccactcggccgcccccgttcctgtgtcgcccgcgccggacagtcccaagcaggtcaaacctgcgctgctgtgccgctggagagagaggttctaatgctcttctgtcccgcgccgcattaatttcgcgattttgagaggtctagtactccggtccggtgtagccgtgtaggaggacgcaagggcaaggcaagaccaccctttttcattttctatttttaccgcgcctcgcgtccgtccacagtgcggcaggcttcttggctcgttgctctcgttccgctcggcttctgcgttcgcctttgccgcctcgctgctgctccactgatcacgttataaggcttccgcgcaggcgagctgctgctgctgctgctgccgccgccgccgccttgtcgggtaacgagcgacctcgacgtcggacgtctcaagtggtcacatgctcgaggtcctggacatggcgccgccgccaccaccgccgccgccgccgccgcatgcgcggcaccatcagggggcagccaagggcggccacgcggagcggaggaagcaaccgctgcagagcagcgtgacgcagcccaaggcggaaccggcggcggcggcggcggcggccgtgctgccggagggaggcaagaggtgcggaggaggcggcgggaggcgccgcggcgggcgcggccgggccaaggcaccacctggtgagcctcgcgtcgcgctagcgctggcgcctccgccgcgcacggtcattggcccgcccgtgccgagcaaggggctgtcgttctgccgccgccccggattcgggaccgtgggcgcgcgctgcgtcgtcaaggccaaccacttcctcgccgagctcccggacaaggacctcatccagtatgatgtaagtgggctcgccgctcatttcgctttcgctggccgtgagcgctagcgcaattgagatcgaaacacaacgtctttttgcattctcctggtgggtttttttgtaggtgaagatcacgccggaggtgagctcgcggaccgtgaaccgggccataatggctgagctggtccgcctctaccgctcgtccgacctggggatgcggctcccggcctacgacggccgcaagaatctctacaccgccgggaccctcccgttcgacgctcgcgagttcgtcgtgcggctcaccgatgaggacgacggcaccggcgtcccgcctcggtacgttgcctgcatttgtttcttgcgctacttgggcagcctcctcgtacgtctgctgccttaatggcatgtcgtactgattcgcgagaattgcgtcccgccagggagagggagtacagggtcgccatcaagttcgccgcgcgcgccgacctccaccacctcaggcagttcatcgccggacggcaggcggacgcgccgcaggaagccctacaggtactcgacatcgtgctccgcgagctcgccaaccagaggtatttattccatcgtctcctgcattgatggcgtcgccgcacattgcccgtctgcgttcttggattccaggaagctaatgctggcgcttcttccccgttggtcaggtacgtgtccatagggcggtccttctactcgccggacatcaggaagccgcagcggctcggcgacggcctgcagtcatggtgtgggttctaccagagcatccggccgacccagatgggattgtcactcaacatcggtgagctgtgcgggctggggaatatttcttgccctcatgcatgtgattcctttcttttttgtcctgtggctgccgcttacatggccatgttgacggcagacatgtcgtccacggcgtttattgaacccctgccggtgatcgagttcgtggcccagatattaggaaaggatgtcatatcaaggccattggccgatgctaaccgaatcaaggtaacattactgtggtcgggcgggcatggaatctagcatatagtagtgcagcgatatctaacacttattatgccaagcagatcaagaaggcattacggggcgtaaaagttgaggtcacgcaccgggggaatgtaaggcgcaagtatcgcatatctgggctcacaacacagccaactcatgaactgatgtatgtttagattctgaatgatttttactagttcctaaagtactgttactgtcatctctctttcgatacatggtgtagcccgatttgacgaacataaaaaagaaatggccatctgtctaaacaaaaggcggttatactcaacttgtgcttatgtttatttatctaagtcaccttagcagtgaatacattcgacaattaaaagtatatgatgatcaagggttgttaaatcaccttagcctgatttttatctaattttcacagtttcccaattgatgaacaaatgaatatgaaatctgtcgtggagtacttcaaggaaatgtatggtttcaccattcagcatcctcatcttccttgccttcaggttggaaaccaaaagaaggcgaactatttaccaatggaggtcagtatagatgctaatcacaaacttatgttgcctgtcaattatctttacgtttctaattaatgttagactctaataatataacgttgtaatattgagtttttttaccaggcctgcaagatcgttgaaggccagagatacacgaagaggttgaatgaaaaacagatcacatcgttgctaaaggttacatgccaaaggcctcgagaacaagagatggatattttacaggttgagatttttttttgttgtaaccctaatattaaagagtaacttttgaacacacacccttctgtatgctgtgctagatgtactagggttttattctaagtaaactgaatcatctctcttgaactaatcttacatatattttatgcggagctaaatgttctagcggtctagtttttttttgttctccatgaactaaaccgaacattgcaagacatgcattatatctgttcattgtcctatcgagtactgcatttattttccagtggtccaagctttccatgcaatgggccttgaataggcagacaataatacagctagggttttcacttttataagtaagtggttttaattaatcaaaacttttgtcaaaatggcttagattattctttattttcagacagttcatcaaaatggatatgagcaagatccatatgcgaaggaatttgggatcaacattagtgagaagctaacctatgttgaagcccgagtccttcctgcaccttgggtgaggataatcttatgtcactgttattcattttttttcttttgggagcaccttacactattatttatgacgctagtagctcattgttgatgtgctgaataacttttgtgaattcagctgaagtatcatgacactggaaaagagaaagagtgcttaccacaggttggtcagtggaacatggtaaacaaggtaagattccagcttgtgtgtaattactatatttgattgcactacttttgtgcctaaaacaaactcattttacagaaagtgataaacggatgcaaggtgagccactgggcatgtataaacttctcaaggagtgttccagaagccacagctcggggattttgccaggaattggcacaaatgtgtcaaatttcgggcatggtacgtacccctcctctgctcatgtttgtgcacaagacaaatacttgtttcaattgaaactgtaagcttcttttaatttgacctcctgaatattacaggaatttaacagtgagcccgtgatgccaatatattcagctagaccagatcaagtagtgaaggcacttaaaagtgtgtataatattgcactgaacaaactcaagggtaaagaacttgaacttcttctggctatactccccgacaacaatggtccgttatatggtgagtgttatctgataattgctttgcatatatagttacttcttaaactcttacatattttctcagatataactttatacatgttgaaagcgatataactttatatttgtaggtgacatcaaacgtatttgtgaaactgatttgggattgatatcacaatgttgcttaaccaagcatgtttttaagatcagcaaacagtacttggcaaatgtctcactgaaaattaatgttaaggtacttaccaccttggttatacatcaaatacagttcagaacagcaactttataagagaaatggctcgatattgactaatgataccatcaaattcagatgggaggaagaaacactgtgctcctggacgcaataagttggagcattcctttggtcagtgacatcccaactattatatttggtgcagatgtaacacaccctgaaaccggggaggactcaagtccatcaatcgctgccgtaaggctcattactactttccatttctgcatcaacatgtcatattcatcaagatatgcacatctttgtcttggttttggacttatctcactcatatgctgctgacaggttgttgcttctcaagattggccagaagttacaaagtatgctggattggtttgtgctcaggcacaccggcaagagctcattcaggacctttacaaaacatggcacgatcctcagagaggcactgtaacaggcggcatgatcaggtttttatctatgagcaatgtgatatcctgaagtgcaatgcataatttaatatagtaaaaatattggttgatttgaacttattttctgtgatgttttctcgtgcagggagctgttaatatccttcaggaaggccactgggcagaagccattgagaataatattctacaggtatgtttgtgcacatgttaaccatcacctgtagcttgtagatggcaataataaaaacatatctgatgcctattattgccatgtgaatcttttgtaaatacgttagatacaggttagcgatgtatgagaatggtggtattcattgctagttacgtatattgtaactaaactattcttttctttgctaatctatgtgtatgttaaatttattgaatttctcttccagggacggtgttagtgaaggccagttctatcaagttctcctttacgagttagatgccatccgtaaggttgggtgcatttaattttttttcttctaattcttctaagccccttcatagagtttactaactagtgcttactttcaggcatgcgcatccctagaaccaaattaccagcctcctgtaacatttgtggtggttcaaaaacgtcatcatacgagactatttacaaacaatcacaaagacagaagtagcatggacaagagtggaaatattttgccaggtagtgtatctatggcctctaaagcttggccacactatttcaactgacatataccaaaatttattggtacttgaactaaaatgtattgtgttttggagtgaaaaatatcgtgtctaattttaagatcctaagaaattagctactgttttgaggcacagtcagatttttcttttgtttaaattgcattacattgaagtacttccccatgtttctatgactgctcacatgttgattgaaacaggaactgttgttgattctaagatatgccacccaacagagtttgatttctacctctgtagtcatgctggaatccaggtaagagtgatgtggtagactgaaatttgtggaatcctgacattacattttagttggaatattctaccgtactgaacctgtcattttagttggtcatatgcacaagctatcgctgcacctagtgaacaccgtatatgctaaaagaataataataataataaaaactgatcctatggtcaaccttttaatcatgtgattgtacagccatggtacttggatcagtagcatgggaatatagtcagattctccgtactgtactgaaatgactgacgtgtggcagggaacaagtaggcccgctcactaccatgtcctctgggatgagaacaatttcacagcagacgaaatgcaaacactgacaaacaacctttgctacacgtaacgcacttctttgtatattttatatttgtcctttgcacatttaaattttttttgagaattttcttagcttgttatacatgttattgatgcagttatgcccggtgcacacgctcggtttctgttggtatgtcctgtgctttacagacaaacgttttcccagctccacaattgtcatcgactctttagcctgctcacctgttcaggaagcaacttcgacctgtgatgctgtatcttttgcttcttaacagtccctcctgcatactacgcacacctggcagcattccgggcgcggttctacatggaaccagagatgtcggagaaccagacgtcgaagagctccaatggcacgaacggaggcttggtgaagcccctgcctgctgtgaaggagaaggtgaaaagggtgatgttctactgctga

SEQ ID NO: 704 - DNA, 8424 bp, Zea mays
cgaagggaactaaaaggcggctcagctatgaagagaggcgaaggcgaactgggatctgggatgatctggaggctggctgccgggctccttttatagggccaagtccgcgacccccgtgcttatccgcccacgaaaatctcgcaatcagttgagattttatagcgatcggttaggataagcgtaacagccaagaaaccaaaaaatcaaacggcaaaaggtagccgcgcccccgcaaggcgaggggccggatttcggcggaccattcacgcgcatgtcgtgcgcccgcgcccttcgccccgccccgccccgccccggcccggcccggcccggccaggcgagcgagcgcgcgcgcgcgtgtggctctccacactctctcctctcatccatgacttggtgagtgagtgtggcttccatatttaagttagctctactccataagagctagcaatatggtgctattggttccacctatccctttgccatccacttatatgggcttttgagattttcctgtgatttattagaaattcttaattgggccaagcccataaatcctaacattattgacgaaaaaccgacggtaaaccgccccaaagtgtcgattttccatgaaaatgaaccggttttcgctgttttttacagaaaatggaaaattttgacaatatttatttgtaatttactcaattcacattgcacagtaaatattaattgatccacacgacatgtgtttaccaaaataacatatagcatgcatatgcaacaaacaaccagcaatacttaaatactagttcttttatagttcttcaacgacatataggttgacttgtttcacaatactcatgtattcaacacgagtcatagtgatagtattcaggtatgttggaagaatcgtgatatggtctctcatcccacccccttgcaccactccccttacagcatatgatccaactgtttcattggcccattcttgcacttcatctgtgtctccttgttcgtgtacaagtgatataaacaacatgctagaaagatgagtgtcactattaggtgaatctttgtccaatgtcgaaggtgtattggaactaaactagcacttaaactggacaaaaaatagcatctaacagtaaataatcttcacatataccatataatagtaaacaaactaatacgactaaactgaacactaaatgactaaaccgaaactaaatcttaacatcaaatccggtttccccaaaaaaaatgtggttaccagttcaaaatgacggttcacatatatccgttttttatcaattatttttaattgttttgaatttaggacgaattttgaagaaaaaaaccgttggttaaactgaccggtttccccaccaaatgctcaggccggaagacttcagcgtaccaccggtcttctgcttgcccaccttggctataaaagctgcccgcagcgtgcgggtgctattcagtttcttcgctcttcatttcgccttccacggttctttccacctagcaaaaccccaagcctccttcctacgatggcctctcgtgggcgcggtggtggcggagggaaaggccctagcggtgggcggggcggtgaaggcagggggcgggggatccgtggcgggggaggttaccatcacggcgacgatggaggcggcgaacgcggaggcagaggcgacccgggccgagggcgcggggtcggcggtcgtggccgcggtcccggaggccgaggtgtcgacgaccaccagcagcagccgccgccgctcgggaacacagagggcggaggccagggccgcggcggcatggcggtagcggtaccgccagcccgccccgccgcgccctgtcctctagcgccggacgccgctgccccggcatttcccgcagcagcggcctcgtcttctgcgcaagcgcctcgagcccccaccgaggcggctggagctgccttggcggatggcatggggaagttggccgtggcggacgaccggcccgctgctcctcccgtgcccgcaggtaaacccgtcgcgcaaggtcccgcgcaccagccccaggaggctccgccactctcgaggaagaggatcgtgccgccgccccgccccggtttaggcacgtctgggagaaagctggcggttcgcgcgaaccacttctttgtcgaggtgtccgtgaacgacatcttccattacgacgtgagctccacccgcacacactccttcttgaacttggttctgcgcttcgcagcgtcgctttgcagcgtccgatttctctcggttgatattgttttgatctttgtacacgatagttttcgattctttctgtacagtcatgtgccgggatgtcgggggtgatattcaccgggctgcggcttcctttcttttcgaaaacgttctatttcagggctttagccgcgctgtaattttggaaaagttacatttcctgtcatcgagcaaatgtctacagcatgattgtgccgtacttgctgccttcttgttctgtatgcgcgtcggcaagagcgatcaaggtctttagcactcttgcattttggtggttgcacggtggattctttgtgtttcttggtgctgggagggttctttgtgtttcttatcaaacaaaaagaagaaatatattaaagccagctgttgggaccgttgatccatagagacaaaacaaaagcagtagaagcgagtacgtattaaaaccaaacgaataggctgaatttatttaccaggtaacttgaaccctcctatagatggccaataagcacgaggcctgtgagactggcacgaagcccgttgtttgggcccggtacgagcctggtacgacccggttctatgcgggcccgggccggcccggcacgaataagcgggctgggctcggacagaaaactaggcatggtgggttagcccgacacggtccatttacctctaagcacgttaaacccgctttttttgtactaaaacatggttttcggcctgtttagcccgctttttcatgctaaacgagccggcccaacccgtttacgcacgctgcgggtcgggctcgaacagagaatcgagcccgtgggcttagaaggcccggtccggttttctaaccgtgcctggcggaccgggccaaaaacgggccgggcttcatcgggctcgtgccaggccgggccgggcggcccgtttgaccatctctaaaccctgcatacctgatcagtagcactgcactgcacacttacagcgaaattgatatagatatccatttgtttgttatcttgcttattctgtcctaggttttgtttgctaaaatctgtgatttacgtttcttatgtatgcaagaaatattagttgtttgtctcttaatgtcttaattattgggatttttttgtgctccatacatatttgactcgatccatacacattatcaggttttaatcaatcctgaaccaaaagcaagaaaaaccaacaggatgctgctctcagagcttgtcaagatacatggcgcgacatctctcgcccacaagacacctgcatatgatggaagcaagagcctgtacactgcaggcgagctgccgttcaaatcaatggagtttgttgtcaagttggggaaggcgggccgagaagtgtaagcaccactcctgtgccctatactcctatgtgcagtacacttgtgacttgcagctgcttaatgctgactttttagcgtcctgttactttaattgctgaaattcagtgactacaaggtgacaatccgatacgcggcacggcctaacgtgtaccaacttaagcaattgatcaattctcagctaaggaacacgccatttgacgcaatccaagcactggatgttgtcttgagagagtcgccttctctcaagtaggatatcactgcctcctcttcactgtttgttctctgcaatattctttttcgttgagctggtagccatatgtgcttactattttttccttttgtttcacagctatgtaactctttctcgatccttcttctccaagaagttcggtgatgacgacattggcggtgggctagagtgctggagaggatattaccagagcttgcgtccaactcaaatgggcctctcattgaacattggtaaatgatcttcttctccaaaaaatcaacttgtacaaaattgcaccaaagatttatttgatttcgatttagtctcagtattgagagctctgactgaacgactctctgtctgcagtttcagtatgggaattttgtgtgtaagccagacacaagtcgctatgctggtgtgccattgttggttcgacatttatgtgtatttcagtggagctttgcatctcaagttcagttggcgcataaatatgaaccgtgctatttggcgtaatcaaaatagccaacttgtgtggtggcatgcatttctgaaagttgaaaatttgcctccaacataggtcttgtttggtagagctctcaacggctcttatagtagaaatttagaaatgcccatgttcatatgttttcgtttttaacctcttgagctcacctctgttcagatatatgctccctcgtttttaacctcttgaatctcacttctgttcagatacatgctcgacttcattttaccaacctatcgatgtggtaaaatttgttgccgattgtctccagctgacaaaccctggccaaccttttttggacagggatcgtttaaaggtacaatttgtggataaaagttgtcacatgcaatttaactcagtgaccaactaatctgttcctatctacaattttttagcttaagagagccctgcgcggagttcttgttgagactgaacaccagcagggaaagagaagcatctacaggataactgggattacttctgttccattggctcaactgaggtacccaccggttcatatctcttccctccttgcctgtttggtctagtaccaagaagacgaacttattcatttccatttcttgtcttcagcttttcttgtaacgaaggccctcagctgactgttgttgagtactttgcacaacggtacaatgtccagctgcgctacactgcttggccctgcctgcagtcgggcaatgattctaagccgatatatttaccaatggaggtaacattttcatctttggtgatttctgcacggcacctggtgcaccatgtgatagttttatcataatgttttttttcaggtgtgcaaaatcattgaagggcagaagtaccctaggaagctcagcgacacacaggtggccaacatactgaaggcaacctgtaaacgtcctcaggatagggaggagaacattattaaggtataggccaagataactttggcttcgacaacagtgccttttcgagtggcaagtgttcacatttaaatgagtaactttttgtactgaatattttcttttgaaatttagcattttgtttcctttcgtcttatcttttgttatttctgatgttttgtcacatcaactaaagtgtcataagtaaaatgtttatcttgtgtagatggttcgccacaacaactattctgctgataagatggcacaggtgtttgggatcactgtggccaaccagatggctaatgtgcaagcccgtgttctgcctccacctatggtatctattatgcaacgttctcagtttgatgatttgtgttttatattttttaaataattccaagaacctgtatttcaactttttcagctgaaataccacgaatctggaaaggagaaaaccgttgcaccaagcttggggcaatggaatatgattaacaaggtgattctatagttaaatatcctgatctttgtttttttgctttcaatatcacttttattttacgttgaaataagtacagaaaagtgtaaacaaaagatttggtggttcctagagttagtagtcttcctactgaggtccaccttttgtttccagaaaatggtcaatggtggaaccattcacagctggacttgtctgagcttttcgcggatcccgcttcgtttggtagacgaaatatgccatgaattggttcaaaagtgcaattccattggcatggtaaattcgtccacatgcttctggatattagtatagttgataacataatcatcagccacagcatgttgaatttgatgtcaatgatcttctagagtttcaatccaaggccggtgacagaagttcagaaagactcacacaacaacatagaagctgctttaagggatgttcacaggagggctccgaatctgcagctgcttattgtgattcttccagatgttactggttattatggtacgtgcatccttgaaaaatctgtgcaacttattataaactttgtgaaaatgaaattacatgcatgttgatatggtgaactttctttacacatttctatttgtgtttttttttggtgtagcatacgcaaggaacattattcacattttatgtgtagcacacgtgcagtttacttttccagggcacttgtgcttgctttcatggtaaacacatattgttgtgcaattttgtaggggaaattaagaggatgtgcgagactgaccttggtatagtatctcagtgcatcaatccgaagaagaatagaaacaagcagtattttgaaaatcttgcccttaaaatcaatgtgaaggtcagtcagtgcaatttactgctttcttatctctggtgtgcttcagttgttatggaaattaaaattttattctatgttttatcaggctggagggcgcaatacagtgcttgagagagcctctgtgcctaatgggataccttttgtctcagatgtgccaacaatcatttttggtgctgatgttacccatcctacagcaggagaagaatcctcggcttctgttggagctgtcagtttcttgttctctgttacaactgtgtcattcaaatgcagtggtaatttagaagtaaattttcactccacatttgagcacaaagtaatggaatagatggtataaccttgcaggtggttgcatccatggactggccacaggtcacaacatataaagctctggtctcggcacaagcacacagggaagagattatacaaaatctcggcggaatgataaggtaatttaatatcctctgtgttcatgaaagctgtgaatgaaactaaggtgccacgtaattatgctctgcagggagttgctgatttcgttctataagaggactggcaaaaagcccaaaaggattatattttacaggtatgtgcttgacttaactatctagataactcttggatgaagccttcatttcgtgacttcctttgcttttgttttgtttatttagggatggaataagtgaaggacaattcaaccatgttttgctccttgaaatggacgcgataaggaaggcttgtgcctctctggaagatgggtatctacccccagtgacatttgtcgtaatacagaaaaggcaccacacaaggctcttccctggagttcatggaaggagagatgttactgacagaagtgggaacattcttcctggttagtaccgcgatgttcatccttgtttaatgacaaccttagcattagcatttgcttgtcactgagattggaccctggttggtttaatgacaaccgccacattagccatactatatctttgggagatctccacttctaacacaagcatgatactattttgaacacatacatgcatgttggctgtaatttgtgactcttttcttcctgttaaaatacacaggaactgtggttgataccgagatttgtcatccgcgggagtttgatttctacctttgtagccatgctggaattcaggtatgttttagcagatacttggcttcttgagtgtgttatattcgtccccctgaatgtagattcatttctccagggaaccagcaggccaatacactatcatgtcctctacgatgaaaaccgtttctcggctgatgggctgcagatactcacaaacagcctgtgctacacgtaagcttagcttgatcctgatccccaatatatatttgctgccatctgaactcaagttttttttttgttgttttgcaaatgcagatacgcacgatgcacgcgcgctgtctcagttggtaagtctatgccagtttcaccaagttctttgtgtgattagtcaagtgtattgttacttcattgcttattggcactgtaatatttatcctgatcctccatgtgtggaacagttccaccagcctactacgctcacctggcagcattccgcgggaggtactacgacgaacaaggtagcagccccgcccccgatggaacctcagttgtcggtggcgatgccgctgcagccggtgatgatccacctgcgtgccgcaggctcccccagatcaaggagaatgtgaaggaagtgatgttcttctgctagttgctcagcgcgagctgcatgtcttgattcaggctgcctcaatatacaagaggccttttttttgtgataaactggtatcgatggttgtcctgac

SEQ ID NO: 705 - DNA, 9752 bp, Zea mays
gcccaaaaccatacccgcgaagaaaaaatacgctcgctaaaaactccatacccatgacgggtataaaatttttgcccaaactcatacccatgcgggtttcgggtaccaaacgggtttcccatacccactaacatcaacataaaaaataattcatcatgtaaatgacaatcaatacattaataagctagcataaaaggaacaagtgataactaattttagcctaaaatttgttacatgaagtttatttcaattagaacatattcaattaataatattatgagacatatttataaggaatgttgattttaagacggatttaaaaaacccatgggtttgcgggtatgggtagtggaagaacaaacacatgcccatgtacccgttggatttccatttaaacccattaacaaacccatgggtagagaaattaactcaaacctataccataatagagaaaacacaccgggttttaggtagcgggtacccattgctatctctagtgccggcatgcagcagaaggagggcgcaggctcctgggccgtatcgtcgatcacctgcgctgcgcatggaagtggtcaagtggagcagccgagcagggcagcaggcaggcaccccactgcacgtcctgccttttcccaccagccgcaaaccgcgcggaaaaagagcctgcatgcggcccctgcatgcaccgtacgtgatcacctgccagtgccactgccaggcagccagcccccgaccagctgctccctccctgcagcgtcgcctgctgccccggccggccatgtggcctgcttccagtggcagctacgagtacgtgcacacgcgcggcggagtagcggagagaggacggacgcgcccgcgcgcgcgagagagaggttgtctttaatttcgtcggcaccgtacgtccatcgtccatgcatgcaggcacgcacacccaccggcaccagacaagccaggggcggtcccactcgatcgtccatgcactgtgtatgtaatcgtgtcgcgcatgctggatcgccgacgtattcacctactcctacgtgtgagcgagcgagcgagcgcatgagacaagacgagacgagagcctgaggaagtgaggaggacagaaacagatgctgctgtgctgcgctgcgcgcgcatatgcaatgcacggtgccgcgatcatccgtcgcacaccgaattgctacaaacccattagtcatggactcagtcgctaagccgcccgtacggacaaactcacagacacacagagatcgcggtaaagctagcgttgcggtgagggagactctgagacgacggcgtcggcgtgcgtgctccacgcaacggctcatggctctagggtttcctctccgcctacgcctatatagcggcactctctccccgcccacctgctcaccctctctcctctgatctccctggttcctacccactgccaaggaaaaaccaccaaccccagacccagccagaggcctctgcctcagcccgtcttcttcttcttctcccatggcttaccgcggcggcggcggccggggaggaggaggccgcgacggggaccagcagcgcccgccgcacgtccacggacgaggagccggggggcccggaggcggccgcaccttcgtctggcctccaccgccttcttccacgccgcggccggtgccgccgtaccaccaccaccaccaccaccaggtgcccatgggctaccgcgcgcccatagtgctgccgcaccaggccgcgtacggggtgccgatggccgtgtaccggggggcgccggcgcccgcgtacagggtgcccgcgccagcgtcccctcggcctcgcgtctccttctcgcctgcgcctccggcgtctccggtcactatcagggcgccgccgccatcaccgacgacgccgccagctgctcccaccactccggcgcctccacgccagcccgcgcccgcgcccgcgcccgagccggccccggccccgccccccgcgccgtcgctcgcggccctggcgaaggaggtcgagaagaagctcttcgtctccgagaccgcgctggcgccggccgcggcggcggcagcggcagcggcagcgcagggcacagctggtgccggcgctgacgacgcggcgtcggacgtcgacctggcgccggtctccaagaaggggctcgcgcacccggctcggccggccctcgccaccgtggggaggaatgtgtttgtccgcgcgaaccacttcctcgtccacgtcgccgacaacaacttgttccactatgatgtgagctagccctcctctcgcctcatgcactagcagtgtatatcttctcgtatgtatccatgcatgcttgttgcttcgtaagatatggtagtagtcgtcttgtgcgcgcgcatgagttgtcagctgggagatatgggcgggtacgtactttgtgacgtaaaaattacacatgcagcgtgcgcgcgatggtccgctctcgttttttgtttcttttttttctttgatccgtctgatccagtgtttctgctgcttgttctcgtggttcctcgttggctgtgtttcttgcgaagaacaatccagtaccctcctgccactatatatatgcagtggttggatcggagctcacgttcatctgcgccaaaaataaagcatgcgcgcggcgtctctctttgcttgggattcttgaccatatggtgctgttgcatcgcggtgatgggactgctattcatctggccacctctctggctctaccgttcatgacagcttgttctgtagtccttctctgcaacgatttttctgctcttttgttttcggactgtttcgtatcgatcgcgtctgctggagctgcatggtgcgtgttctttggttggctgtcgtttgagcgcaagctttttcagctttcagcagtagtttctctctctctctccctccctcttttcggatcttttgtgtttttgttttgaaactagctatggacctatatggtttctcgcactgtcaaattaaatctgtctctcggctctcagtgagcctctttgtgccgtgcaacaaatacgtctaaacgttccatcgttgcgcagagaggccccagctgctgtcttgaatcttgatctcttctcctttctcgttcattttcctttctgatttgtcagatgcattttttttgctgcctggttttaattagtttttttttcctacttgagcttgattggtatacatacatggaacttgctttcagttccatacgcgcgtggttcttgcttgtgtgagaaatgcatcgccatgcatgcataatccctgccaaatgccatgggagtagacgcttttgatgaaacagctgctgcaggcggcttgcatggcagtacaacttgttgctttttgtttgtttttcttctttgcgatctggtcagatccattgtgggggtttctacagtgacccttcaaatctcgtgcagcataacctggccgtgcagcagcatatggttccaaattaagtttctgtacgagagcgggagattctttgtgttgcttctttttggaacttctcttggagttttctcgatcatggtcgattatattggctacacagcaaattaccatatccttgtctacgccagtaacttttctttgacacgtaaatgaccgatgcttttcgaagcgttttacatgtgtgagttctttttttccccaattattactagtagtcaacgtagtgtgtatctttaagattgtgattttattttcactgccgtaaatgtgtgaaaggaaatgcttcaggttaaagcttttttaaataatgacctgtttgtggggactgaaaaaaataatggcatatttgctatacacacttcgtcgtccccctgccccattttaaacactttgctattacagcttcacccttcccacactcagcgccagcaaaaaaataatgcaaaaaaataatatagaacgaacacttaaactcatacacatctgctccagaaatttaaagctaaccatcagaccacacatcttattgtttaaaaataaacaataattatatttgtaacgtagatgtcactcccacgctctcccgattcgtggcaagcgtatgtacacataactagtagcaatatagaagaaccctagtcaattgactccctgcgactgccagattgggtcattttctagcccacagtccacaccgctggcgctggatccccatggcagcgtcgcaactaaactggcgtaacaggctccgctgcacaaagcaaccaataccaccaccaacaacaacaacaacaaaatgcaaatcctcttcaacccgacattaggttaattggcttgtcaatccacccagaacttggcaatttccttcgcacttcactgtaagctgctttgattttcttaaccctagcaccaactagtgtccgctttttggctccccttaatatggcaaactttcttattccctgaccgcgcttgtatcttgaacattatgaatatataatcaatcaggtggggattcttcgtcccccccgttgcatgtttcaaaaaaaaaaaatcttaaccctaggataagtggatgtttgtttgggattataatctatctagattatataatccaataatttttgaactaagagttagttcaaaagttgttggattatataatctggatagattataatcccaaacaaacaccccctaagtaacttgcaatgctgtcttgtttatcgaatctaggacgagaatttcattatcctttcactaaggattctgactttttttagtgtttatacctttgtgctctaatgtgtgaaaccatgatccagttaatctcaataagaatattatgattcattttgcctggtggtttatgtctttaggtcgctattaatcccgagtcaaagtcaagagcaacgaacagggaagttctcaatgaactcatcaagttgcacgggaagacatctctgggcggcaaattgcctgcctatgatggcaggaagagtctctatactgctggttcacttccttttgaatcagaggagtttgtggttactcttgttgatcctgaaaagaaggagaaagaaaggtcttcccagatcctatgtcaggccatttttcagtactacacgaaagacatttctcacctgctcatattaatccttttcaatttatagggtggagagagagtacaaaatcacaattcgaattgccgggagaacagatttctaccaccttcagcagtttctgcttggaagacagagggatatgcctcaggaaaccatacaagtacttgatgttgtcctcagggagtcgccgtcttggaagtataatacctacactcaagttcttgctctgaattttgtttgagtaatcttttacccagggtactgacaactctttggtaaaaaaattgtcactgcagttatgtcacagtgtccagatcctttttctctacaacttttggtcacagaggtgatatcggtgaggggcttgagtgttggaggggttactaccaaagcctgcgcccaacacaaatgggcctttcgctgaatataggtaataccctgtttatgtcgttgttcctcagcaaaaaaatgtttttgttggtctatgccttttgtttgatatattttggtaattaactttggttataatgttgccttttcagatatttcagcaacatccttttttaagcctgtgacaattatcaaatttgtggaggagttcctgaacctgcgtgatacatctcggccgttgtttgacagagatcgtgtgaaggtattttttacacaatgacaatcgcgataacttcttttatagaacttgtacagcacgccatcctagagaaatcttgtatggctgtaactgtgttcagataaagaaagcattgcgcggtgtccgaattgaaacaactcaccaacaggaccaaatcagaagatacaagataacagggattactcccatccctatgagccagctgatgtaagtatttatctgcaaatgatactcttcttttctgttctctctacagcattttctgtaatattaatatcaatattaattctggttttctgaattgctagtacatctcttactaactgctaaatagttgtagtattacagttatcacaatttgaacgatctgacctatgtcaacagtgccataaacttatttttcctttttgtcattgtcatcaactgaccgcttcttttttgtcactttagattccctgttgatgataaaggaacaagaaagactgtagtgcagtacttcttggacaaatatgactacagattgaagtatgtctcttggccttgccttcaggctggcagtgattcacgacctgtatatttgcctatggaggtactgtgtccatgatcattcagttgtacctgaattattcatgttatgttcatagtttcaataaaaatggttgtaggtttgcaagattgtagaagggcagagatactctaagaagcttaatgacagacaagtgacgaacatacttagagcaacttgtaaacgtccccaggagagagagaagagcatacgtgatgtatgcttctagacctttattcctctgctgtttttagaataattattatctcttttggatatcatttttattgacattttttatgtgctgcatagatggttctgcataacaagtatgcagatgataagtttgctcaggagtttggcatcgaagttagcagtgatctagtgactgttccagcccgtgtgctgcctccacccctggtaaaattgctaagttcttttttgcaaaatgtgtgtccatgaatcacttttgttttattatttgaggaataatcaatttctttgttgtatttcagttgaaatatcatgactctggtagggagaaaacttgtgcaccaagtgttggacaatggaacatgatcaataaggtgacactatgttcttacttagaaatttatctctgatgttagttgagcattgccatcgttgtcaataaatttattgtgaacttgtccagcatcatcatgcactggttgtcaagcttttatgagtgtttgtttttctttaatgttgaaactattatcgccatttttctagaccagtctttttaacactgttctggtaccctttcccagaaaatgatcaatggtggaactattgataactggacttgtttgaacttttcacgcatgcgccctgatgaggtacaaaggttctgtatggatctgactcatatgtgcaatgccactggaatggtaagttttttactatttgtatgtgttatcaagttatgccagatagttcactatatatactgtagtttttacttctaatcatctctgtaggttgtcaatccacgcccatttattgaagtccggtctgctgctcctaaccatatagagaatgctttgagagatgtacacaagagagccacccaaatacttgcccaacaagcagtgggaaatcagctccagcttttgattgtaattcttcctgaagttagtggttcttatggtatgcatacttgcctcttgttctgggtcatacacaccttacagtttattagaatttttggtatataaatgactcctacttttgcaggtaaaattaaaagagtctgtgagactgacattggaattgtatctcaatgttgcttgccaaagcatgctagcaggccaaacaagcaatatttggaaaatgttgcactcaaaatcaatgtcaaggtctctcaatacctatattttttacattatgcttttttttattttggttctttcctgcaggaatgtaacaattcctttcgtcgagcaggttggtgggcgtaacacggttcttgagcgagccttttcacacgatggtataccttttgtctctgaagtcccaacaatcatctttggcgcagatgtcacacaccccccaccaggagaggactctgcatcatccattgctgctgttagtttcttcttaatcaatcataatttggtgcaatctgaactatgaaaaaataagttatcatgttgctaacttcaaacattcaaattgtgcaggtggtggcatcaatggactggcctgaaatcaccaagtacagaggtctggtttctgctcaaccacaccgacaagagataatagaagatttatttactgtcagtaaagatccacagatggggcacaacgttaatggtggcatgatcaggtaaggttttttattgatttgagttgacctattgaaagttgtcgaatggttcatctgggtaactggcattgcagggaactactgattgctttccgcaagaagacaaacagaaagcctgagaggataatattctataggcatgtgttccagattcctgtttttggttcatttattgtatgctgttgagtgaagtatgttgacttatcactcctatgcagggacggtgtaagtgaaggtcaattcagccatgttctccttcatgaaatggatgctatcagaaaggtatgatttccagcatcagaatttgtcggtgaaatatggttttcattgccatgcccatgtcaatggttttgtccctttccatttcaaggcttgtgcttctttggaggagggatatctacccccagtgacgtttgtggttgttcagaaaaggcatcacacaaggcttttccctgaggttcacggaaggcgtgatatgactgataaaagtggaaacattcttcctggttagtgtttttgtgtcacactgttattgggttcataaagctgctgcttctataagcatttgctgtctgggccttattttgcgcgtcacttgtgctgcaggaactgtggttgaccaaatgatttgccaccctactgagtttgatttctacttgtgtagtcatgctggcattcaggtacgttgcacattcttttccagaatagcacttgtcagacattgagtgtcaaaaatatttcttgtcagggaacaagtcgcccgacccattaccatgtgctctatgatgagaacgaatttactgctgatgcactgcagtcactgaccaacaatctttgctacacgtaagttcaactctccaatctccctccatctctgactctttgatttatctaacatctccctactgttacttgatgaaatgtgcagctatgctcgttgcacccgtgctgtatcagtgggtaagctcttattgcatctcctcttctgtgtcctatcataatctactcagctgaaccttttgttgatatgagctatttccttgtgagcttgaaacatgagaatttcaagctctttgatatgatctttaactgcaaaacgggggtagttcaatgagtgaacacattgacagcatttcttttaaaaagttgttgtattctcaacctgtgctatgtagattgatccattgaaataaataatcaaggatattattgtcagctctaacacccatctttatctgttgggttcatgaatcagtgtttctttgttattattagcactattgtcgccctttacggctgtaactatcatatggacaactattttcttgaaccatgcatcatttcattgtgctcttttatgttgtagatgcaaaatagttggttaccagtcatcgctaatgtggtgttctttgctttccagtcccaccagcgtactacgcccaccttgccgcattccgcgcacgctactatgtggaaggagaaagctcagacggtggctcgacacctggcagcagcgggcagacagtagcccgtgaggggcctgtcgaggtgcgtcaacttcccaagatcaaggacaacgtgaaggacgttatgttctactgctga

SEQ ID NO: 706 - DNA, 3893 bp, Zea mays
aagcctgcacagttgggaacgcctgatttccctgtgcccgcgtatgcaggcaagaggccgctttttcactatttggggccagcatatgagagctattcgagcatccaaacaaccttgtttgcactaccagagactgttcacggagttgtgcagcgtaccaaacgcacccataaactcggtttttccatgttccaggttcaggcagctcctaaaatttataaactgctcccaggccgtccaggtcttatgtttgaggatcctttcttcaactggtttagggatgacacagatgaacaatggaccaggacaattgattttactccatcagctagcatcgggcaatcatctattttatgtctggaggtgccacaacagtgtgagcttccaagaattggcgactactttgtttactataaagagcagaatcttgactttgaatgtcggaatgggtattcatattcctgtggtagcaaccttgtaccaattgtgaaatctcctgattacatagaggtcccttatgagatactcttcaaaatcaaccatttggttcagaatgggacactcagtgggccaacagttgatcatagtttcttccgtcatgttagcccaaaatttgaacctattgatcatataaaacgagcacttttaaagatgacatatttgaaaagcacctgcttgaacccaacagattggttatctgtgcaatactccagaatacggaaatcacgccatgcatcacaaaagttatctaatatatctctggatgatggcttggtctatgtccacagggtgcaagttacccctgctaaagtgtatttttatggacctgagataaatgtctccaatcgcgttgtgcggcatttctctgcagacatagataacttccttcggatttcatttgttgatgaagactgtgagaagctccgttcagctgatttgtcacctcgatctacttctggaaatgatgcaaggagaactgctctgtataatagagttttgtcagtcctttcaaatggcatcaatattggtgacaagcactttgagtttcttgccttttcttcaagtcagcttcgagataactctgcatggatgtttgcttctcggcagggattgactgcgagcgacataaggaagtggatgggggactttcgagatatcagaaatgtggcaaagtatgctgcaagacttgggcaatctttcagttcctcaacagaaactttaaaagtacacaaatctgaggtggaacgaattcctgatattacaaatggcacaaagtacatattctctgatggagttggaaagatctcagctaattttgcagtggaggtggctatgaagtgcaaattgaaacgctttgctccttctgtttttcagataaggtatggcggttacaaaggtgttgtcgctgtagatacaagatcaaatcataagctttctttgagaaaaagcatgtcaaagttccagtcagaaaatatcactcttgatgtccttgcatacagcaagtaccaaccatgcttcctgaatcggcagttgattactcttctctcaacacttggggttagcgataatgtctttgagctaaagcagaaggaagccttaaggcagttgaacagaatggtaactgaaccacaggctgctcgtgaagcagttgaacttatgcccatgggagaagtaaccaatgtagttaaagaattgttgtcatgtggctaccagcctgatcatgagccatatctttccatgctgctacaaacttttagagcatccaagcttctagagttgaaaacaaagtcaaggatattcatcacacaggggcgagcaatgatgggttgcctggatgaaacctgcacacttaagtacggccaggtattcgtccaagcttcttacagtgcagatgaccatcgcaaggtcgttgtaactggaaaagtagttgtcgccaaaaatccttgtctccaccctggtgacatacgggttctccaggctgttgatgttcctgctctgcaccacttgtttgactgtgttgtctttccacagcagggaccaaggcaagtgtttaacaatatattgtcatatgttttctagtaaatttcaacaggctcttatcttggaacatgtaatttcttggtttagtatgtttgtaccaattgaaacctgttgtccattttgccttaagtggatattaatcctattgtgacattttatctctaaaccagtttttaattctggtatgcatgaatgcaggccgcaccctaacgagtgttcagggagtgatcttgatggggacatatattttgtttcttgggatccacatcttattccgagtcgtttggtggatcctatggactatactccagcttcagcagaaacattagaccatgatgtcactattgaggtattttctagttgaaaccatccatcttcccttccgtgccattgatgctagcaattattctgttggcatcaatgctgtcatttagtttgtgttggtcaatgcgttgctttctatttggcctgattctcgttctcctgaacaacgaagttcaaagttttatttctcgtaggatagtttactttctttgctcgtggtggcagcagttatatgcaaattaaacagatagaattaacttcaacttatgaacaaatctcataccatgctttgaaatgatcaatcttgttattttgttcaggagatacaggagtacttcacaaactacatagttaatgagagtcttgggattatcgccaatgcgcatgtggtctttgcagatcaggaacgtatgaaggctgagagtccaccgtgcgttcaactggccaagctcttctctatagctgtcgatttcccaaagactggagtgccggctctgattccacatgagctacatgtcaaggagtatcctgacttcatggagaaactcgacaaagtcacctatgaatcaaagggtgtgatcgggaagctctatagggaaataaagaagcacacaccacacataaagcacttcacgagggaagtggcaaggcggtcttatgacaccgatttgattgttgatggctatgaagattacattactgaggctatagagttcaaggaagagtacgatttcaggctgggtaatcttatggaccactatggcataaaaagtgaagctgagataataagtggatgtattctaaagatggcaaagaatttcaccaagagtagtgatgctgatgcaattagaatggcggtgagatctttgaggaaagaagctaggtcgtggttcaatgagatgagcacaggagaggatggccaagatgccatggaggccaaggcctctgcttggtaccatgttacttatcatcagcagtactggggcagctacaatgaagggtatgatcggccgcatcttattagcttcccatggtgcgtatatgacaagcttgtggccatcaagcaggggaggaatctcctcacgcggatggatcgaaacttgaggttccgttgagcattgccagcaggtttgctcctgtacatatccctgatcgtttgcactcagcactgccagcaagtgtgcatgaacgatctgatgaattaagacgggcaaactgccgcaagctgacgctctggcctacgtgcgtcttgaaactttcggatgctgccgtctaactaaatgcatgttccttgatttccactgggaccttgagtttgaagtgtgtaaatatgctgcttatgatgtttttagtattggacctctatcaactgccgttctagttagtaacaatggttgccagtcatggattaccaggtttcgccgagctcctgtatggacgaccacgaaggtctatttcttccattaccaagtgcgaagtgtcacatctaacttgcgtagttgcattcaccttttttctcaaaaaaaaaa

SEQ ID NO: 707 - DNA, 8908 bp, Zea mays
  misc_feature (1371)..(1470): n is a, c, g, or t
accggccatggactgcggcgccgatgacggcttcgtcgccgagatcgaccggatactcgagagcatcaacgccgaggccacccccgcaccgccgcctcctcctcctgcgcctgcgcctgcgccagcgccagcgcctgtggctccgctgcagccacagccgcagttgcaggaggcggctgcgaccgtggcccacaatgcggtggcggtgtcggacgtggcgcagagggccccggccgtggaagcgaggaaggagcccaggagggagttcccggtcgccgcggccaatggcggcgacgactgcagggacagcaagcgccagcgtctccctgcgggtggtaccgggggaccacgccacgactggcggcggcgtccgatggcgcccccgcctccatcccgtgggtgggaggaccgggggcgcggaaggcgggagtacgacaggcctcgtaagcgcgaccgcgacggccactacggccaatgccatgatcaccaccgacgcgaccctcggggtttctgggagcgcgaccgcggcggcaagatggtgttccgccatggcatgtgggaggctgaggcggaccgccagggaaagcgtgccaggacgaaggatggatgccctcctgcggagaataaggcggaggtggatcggtcggggaaggagaagcctgccactgaggagaaggcgaggcagtaccagctcgaggtgcttgagcaagcaaagagcaggaacacaattgctttccttgaaactggtgcggggaagactctcatagctgtgttgctcatcaaaagcatctgtgacaaaatgctcaaggagaacaagaagatccttgctgtcttcttggtgcctaaggtgccccttgtgtatcaggtacagacacacgagtgagcctttggacattcaggtcgcaaattttgttgatacaattatattttcttggtggaattgcagcaagctgaagtgatacgcgagaggaccggctatcgtgttgggcactactgcggggagatggggcaggatttctgggattctagaaagtggcagcgcgagtttgagtcaaaacaggtaaaatcctgtgcgtggccgtacttttacttccaaactattttcagatacaatgccccatggccaagctttgatcaaacctgtgcttaggccacttgagttaggaactatagtgtagtactatgttgttgagctaactggttagtagccgagacacttgcattaagtctcattgtttctttgcagattatgaatttctaaaaaaattctttctctagatgtaaactagtagccgaggcacctgcattaaatctggccgtgcaggacgtaaactagttggatcttagtttctaagaagaaactataattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgcaggtttaaacgattcgcccttggtctagagatgagctacgtcttgtctatggtgtttctgagcgtacagaaagcgatggtgcagctaatttaattcagaagttgagagctataaactatgctctgggtgaactaggacagtggtgtgcttacaaggtactgcttcacatcagtgaactagtgtattgatatctgtttcgtgtttctaactgctatatctgtttaacttcaggttgcactgtcattcttgacagcactacagaatgatgaaagggccaactatcaggttgatgttaagtttcaagagtcatacttgagaaaggtagttgatttgttacactgccagttgactgaaggggctgcaatgaaaagtgacagtaatgatgttgaaatgcataattctgaaaaccccaagccaaatgaacttgaggagggagagctacctgacagtcatggtattaatagtcttcttgcaaaatgtgttatatggtgacctttttctttttaacattccccaatgaatttcccttcttccttcactctacaattagcacatattgtgtttattttttgtcctttattataccttaggatatacaattagcacctattttgtttttttttgttctttattatacctgagggtatctcagcctcacttttaacgctttatgctgttatttcccactagctgtttctgtaggtgaacatgtagatgaagtcattggtgccgcagtggccgatggaaaagttaccccaagggtgcaagctttgataaaaatacttctcaagtatcagcacactgaggattttcgtgctatcatatttgtagagcgagtggttacagcattagtcctccctaaggtagggactatgttttcaacatcttaagatcaattacttctcaaccttttatgaattctctgacctgtttccctttcacgacggcttaggtctttgcagaacttccatcgttgggctttatacggtgtgcaagcttgataggtcataacaataaccaggagatgcggtcgtgccaaatgcaggatacaatcacaaaatttcgtgatggccgtgtatgtttctattcatgacgatgacatgatttaacatagtgtttgttgtggcacacaccttttatggtttaactatgttgttagctaggcttaacgatctgcattcagtggttttatgcaatctactaaattccatgatgtccaagtatgtttctactcatgacagaattctacattcatattttttgttccaagtacatgtctgttgtaagtttaaaactatgtttaactgtgtgctgtgtatatttacgattaaaacagatatgtccatgtacatatctgttgtacgttaggtgtatatattggagttgatctgtgcctcacagggtttttaaggcgtcgcctaggcgtccagtcgcttggctaaacctagccgccttgcccgcctagggcgccgcctaggcgctaaggcactcggagtgtttgcttgctcgcctaggcgccttaagaacactggtgcctcatacaccagctataaaaaatctctgttatgggtttgcaggttacactgttagttgcaactagtgttgcagaggaaggacttgatattaggcagtgcaatgttgtcattcgctttgaccttgcaaagactgttttggcctacattcagtctcggggtcgtgctagaaagcctggatctgactacatattgatgcttgaaaggtaattatgtgtcaccaaaactcttgataccgttaaaatatactccatttaaatcatcgacttatataaattaattctgccagaggaaatatgtctcatgaagctttcttgagaaatgctcggaatagtgaagagacattgagaaaagaagctattgagagaactgatctcagtcatctcgatggcacttctatgctaagccctgttgatatatcacctgattctatgtatcaggttgaatcaacaggtgccgttgtcagtctgaactctgcagttggactcgtacatttttactgctcacagctgccgagtgacaggtacataacttcttgtgatttgtttggtatactagctcaattgattttgaaatcgcaggctcatcagtagtttcctcattccagatactctattcttcgaccggaatttattatgcaaaagcatgagaaaccagggggttcaacagaatattcttgcaaacttcaactcccttgtaatgccccattcgagaaacttgaaggtcctatatgcagttcaatacgcctggcccaacaagtaatgacagttcactggaacaaaatattatttagttttttttccgtacattttatctattagtttgaactgtgactggttctttttgtgcaggctgtttgtttagctgcttgtaagaagctacatgagatgggtgccttcacagatatgcttttacctgacagaggaagtggggaaggagaaaagactgaacaaaatgatgaaggtgatccactgcctggaacagcacgccatagagagttctttcctgaaggggttgctgaaattctacatgtcagtattttcgttctcacattacctgagcttgaacttaacttaatggtgctttgcgaattgcgatctgccggtacttttaggttctgattagtttcatttcactaaactttgttttcaacagggagaatggattttatctggaagagatggttaccaaagttcacagtttattaagttatatttgtattctgtgaactgtgtaaacattgggacttcaaaggaccctttcgttacacaactttcaaattttgctcttatttttggcaatgagctggatgcagaggtaactttttcctggtgatattatgcaacttgagaaaataaacatttaaaatcctatgatgtttcgatgttttaggttttatcgacgacgatggatctctttgttgctaggacaataataacaaaggcatctctcgtattccgtggaccaattgaaattacagaaagtcaggttaattttctttgcaatgatgtatcaaagttcatttctattttttacattaaatgttgctaaacttgctcatgtgcttccagctgatcctgcttaagagctttcatgttaggctcatgagcattgtacttgatgttgatgttgatccctcaacaactccttgggatccagcaaaagcatacctctttgttcctgtgggagctgagaaatgtatggatcttttaagagagatagattggactctagttaatagcattgtgaattctgatgcctggaacaaccctcttcagagggcacgcccagatgtctatctaggcacgaacgaaaggacacttggaggggataggagggaatatgggttcgggaagttgcgccatggaactgcatttggacagaaagcccaccctacgtatggtatcagaggagccatcgctgaattcgatgttgtcaaagcgtctggattagttcctggtcgtggatggggacattttaatgattatcaaaataaaggcaagttgttcatggcagattcatgttgggatgccaaagatcttgctggaatggttgtaactgccgcccactcaggaaaaaggttctatgtggacagtatttgctataatatgaatgcagaaaattctttccctaggaaagagggctatctgggtcccttggaatacagctcgtttgctgattactacaagcagaagtaagataagttttgagtgctggaagcaaaaggagttctctcttagctctacctccttttgatttccctttttttttggcaaagtagctttatggcagcataccatgatgattcttgtttttcctctcaggtatggtgtggagttagtttataagaaacaacctcttatacgggcacgcggtgtttcatactgcaaaaatctactttctcctagatttgagcattctgaaggtaaaagctatgcatttcttttgtgagatttcttttagactttttttgtttgccttaatattttgctattcattgatgttttggtctttcaagcccatccaagacttcccagcactagattaatttaataaagaaatacaaacttagtgcttaatataacttatatacttgcaaatgggaaagtgtttggtataatggatttgtactactattgttttgcagctagcaatggagagttctcagagaatcttgacaagacatactatgtatatttaccacccgaattgtgccttgtgcatcctctccccggatcacttgttcgtggagctcagaggttaccctcaataatgagaagggtggagagcatgcttcttgcaattcaactgaaggacataattgggtatccagttcctgcaaataaggtacacttgcagctcccaatcgagcatgttttagggaaaacttttgaatgtcccccggtagaatttaccggtaaattgaacacttaaatttgtcctttctatattacacaactgtcttctactaagatgtcagactacatgccaactaagtggagcacccaatgacacctctaggccttcattgttgctcctagccttggtggatcgtgtctgttgacgggaaaaaattgttaaacaaaccaatatgtactcaatccaggtgctactgaatactaatgatagttttgtacatgataatatgcagggtaaatttaagggtctagtcttctgaaaagatcatgcttgtttgcctaatgaaaaaaatgtggagtgccataaacctgttctctattcacctagattcatcatgcaatagctatatgttattctgcacattgattaataattaatagctttttgtttgtgtggttcacagatattagaagccttgactgctgcgtcatgccaggagacattctgctatgaaagagcagagctgctgggtgatgcatacttgaaatgggttgtgagtagattccttttcctaaaatatcctcaaaagcatgagggacagctcacaaggatgcggcagcagatggttagcaacatgatcctgtatcaatacgccctgaataaaaacctccaatcttatatccaagcagatcgatttgctccatcaagatgggcagctccaggagtgttacctgtatttgatgaagaaacgagagattctgaaccatccatctttgatgaggaatttactcctagcagtgagttacaaaagaacttgtatgatgactatgatggcgatagcatgcaagaagacggtgaaattgagggagattctagctgctatcgtgttctatcaagcaaaacattagcagatgttgtggaagcacttattggtgtctattatgtagctggagggaaaattgctacaaaccatctgatgaaatggatcggtattaatgcagagttggatcctcaagagatcccatcttcgaagccatataacatacctgagagcataattaaaagcatcaattttgacacattagagggtgcattgggtatcaagtttcagaataaaggcttacttgttgaagctataacacatgcatcaagaccatcatcaggtgtttcctgttaccagcgcctggaatttgttggtgatgctgtattggaccatctcattacgaagcacttattttttacttatacggacctacctccaggccgcttgactgacttgagagctgcagctgttaataatgagaactttgcaagggttgcagttaaacataagctacatgtacatcttcgccatggatcatctgcattggagacacaggtgggccattcttaatgttcagtagtgaacttccttgctacccactccattccaaattattatttttatatgcatagctttttatgcacttagaaatacattatgtctagatttgtagtaaaaaacagtgtatctagaaaagctaaaacgccctgtaatttgaaatgaatggagtatgtgttacttatatatgctgtaatgtttgaactagagttctgtcatgttgaaaatattggcaccttttggaagcagtgctgactatattctctctatcctgtgaagattcgagagtttgtgaaggatgtccaggaggagctttcgaaaccaggtttcaattcttttggccttggggattgtaaggctccaaaggttctcggagacatttttgagtctattgctggcgcaatattccttgatagtgggtgtgctacctccgtagtctggaaggtagtttctgtgttctttggaatgaaattctgttcatactcatgtgggaaatactgaagtttaatttttttaatccatcatgtcaggtttttcagcctctgcttgatccaatggtgacgccggacacccttccgatgcaccctgtaagggagctccaagagcgctgccagcagcaagccgaaggattagaatacaaagcatcccgtacaggcaatgtagctacagttgaagtcttggttgatggcatacagattggtgtagctcagaacccacagaagaagatggcacaaaagttggcggctagaaatgcacttgttgtcttgaaagagaaggaaaccgcagcaaagaaagacactgaaaaggatggcgagaagaaaaacggttctcagttcactaggcagactctgaacgacatctgcttgagaaggcaatggccgatgccacagtacaggtgtataaacgagggtggccctgcccatgccaaaagatttgtttatgcggtaagggtaaatacatctgacagtggatggactgacgagtgcattggagagccaatgccgagtgtgaaaaaggccaaggactctgcagctgttcttctgctcgagctgctgaatcgaaattaccgtggcaagcctgatggaaaataatctttggtgatgttctgtggtggtaggtagacgtggaagcatccatcattctgattatacccccatgcagtgcttttcagcaaagcaaattaatggcctttgttgatgttcttggtggcggtattggtgatatggaggcattcaatgcaagcataagcagagctatggggagtgggattagaggattattattagttttgtctgaggtgactactaggtattttactggcgaggtactgaggtcacaactcacaaatagcagttgcaaattgcaatagaggaaatgatgataggttgatataggatattggaggcctcttattcatcgattgtataagatgtttacagaacagtgcattgatccattaaatttatattgattgatatttttatagtggtatactactaacggctttcttatatttcgtcccgctatgtattcagtggcttagatgtttacaaacatctcacattcatacacaggatgcgcctgcagctgggaactcggggttctctatcttggcctcgccgaccaaatatcacgtacgtcgacgtccgcgaacagtat

SEQ ID NO: 708 - DNA, 3984 bp, Zea mays
actcctctgcttcttagtacaggtgttgtaaccgcccaaacaattcctccgttcaagttagaactaggctggtttctgagggatggttttgtggatatggtaaaagatatttgggtaaatgagacaagaggttctactcctttggagaaatggcaagccaggattaggaaggtacgccaacacttaaggggttgggcaatgcacacttcggggttgttgaaaaaggaaaaaaaggagatcatcactaagcttgatgatttagataagagagctgaagtagttctgttgagtactgcggagttggatctgcgcaactacttacaaaacaggcttgctcagctactccgggaggaggaaataaagtggtatcaaagagcgaaggtcaaggagctcctggagggggatagtaatactaaatattttcagatgatagccaatggaaaattcaggaagaatcgaatcttccagatgacggatggagctcgtatgttatacgacgagggagaataaaaaagtcatataactagttattataaaaatctctttggccccccagaaagcacgtcttttactctggatgaggatcttagagatgatataatacaagttactcaagttgagaacgagaagctcacccagccattttctgaagatgaagtaaaagcggtggtttttagtatggaacataacaaggctccaggtcctgatggattcccggcggaattttatcaaatctgtaaagcagaggcgtggcgcggtggcgtcgacgtcttcttcggggtcgtgtgaggcgctcaacctatcgcaacagagacgacgaagggataggcgagagaggatggagaggggagaggaccacggagattggttggagcgcaacgcgacgcgggcgggcgaacgatggcggaggatgcggatgcggaggggaggaccatggaggatgcgtctgcccgaagcagagatcgaggagcattgatggcggggctcgtagatggcggatcgagggtgcgttgatggcggccgcgctgcagggccccggatcgtaggatcggcgttaatggcggctggcatcgcggtgatggcggggagcagaggggcgggtgggcagagggatcggcagaaccaaaatgtgcacgcctacagtagcgtcttaagagtagtaaagattggtttgctatagggcttgaatatgttcaaaacctcaattctttgatcatacttggagcttgggccatctggaatcaccgcaaccgttgtgttttcaatggtgtgcagccttgttctagcatggtcaacaagtgggtcaaggaggagtcacctctggtgtagggctggagccagtggattagatagcatcctttccgctccagcgcactaatcggcgaccttctgttttgggtttccatggtcatgagtatagctgttcatactatcgttttatttctagctatcctttagtgcgtgtgggttcgtgtggcattgtatgaggtttttatcctcaccttttcttcttaatataatgatatgcagctctcctgtgttttcgaaaaaaaatattcaaaacccaactacaaaccaagaaatttcaatgttttagctgtaacaattttaaaataagtttctgccttcaattctattgtcatcattctggttgttttctctttggtttcttgagcaggttggaggaaaacatgaagtgcattgtttttgtgaaaagaatcattgtcgcaagagtagtagttcaaattctccaaaatctgaagtgccttgatttttggagatgtgagtttcttgtgggatgccactcggggttaaggaatatgtcaagggataagatgagttctatcattgaaaagttctcttcgggtgaggtataatctgaagtctgtccatccttaatagttcttgtcaggtttatctattatctccactaacaccagtatatatgtttatgcttcttgtgttacagcctttttcaatactttttttgcaggtaaaccttttggttgctactagtgtaggtgaggagggacttgatattcagacttgctgccttgttgtgcggtttgatctccctgaaactgttaatagctttatccaatcaagggggcgtgcccggatgagtaaatcgaaatatgtttttctcttggagaggtcattttcgtaacacccacccacatgagcacacacacccactcaccgattacactgttctaatttacacaaacctatcataatgctattaacattttccttgaatttagttccttgtttttggttctagaccttgaagctcttcattttgatatttactaggggaaatcattctcaggagaagttacttgatgattatattactggtgaaatcattatggataaagagattaacttgagaacatcaaatgatatgttcaattgccttgaggagaacatctatcgagtcaatgatactggtgcttccattagcactgcttgcagtgtatctctattacatcgctactgtgataaccttcctagagatatgtatgcaaaggatcatttattattctacccattttgtgtcatgggaatatcctagaataatttgatacatcttgttgcagtttttttgttccttccccatcattcttctttgttgatgacgtcgatggaatagtatgcaaattaattcttccaccaaatgctgctttccgtcaagtgaatggtcaaccctgtccatcgaaagatgaagctaagagagatgcatgcttgaaagcatgcatcaaacttcatgaactcggtgctttgacagattttcttctacctggccaaggctctagaaagattaaggtatcaacaacaaataattcagaaagcaacaaagacgatggtatggtcatcgttcattattcagaatataatgcggaaaatattggtaatttagcttaaacatattttttccattttcagatgaaagttttagggaagagctttatgagatgttaatccctgcagttctgagaccttcaagatgcaaactagactcctcgtttaagttgcatttctattacatagaatttattcccataccagcagatagacgatatcagatgtttggtctttttgtgatcaatcgccttccagaggaatctgaaaagttggatgttgaattgcatcttgctcgtgcgaggattgtgaaagcaggaattaaatatttgggaaagattgagtttaacaaagaagaggcactgtcttgcttatctgttcagatgccaacacaaaattttcagggagcaatgcctgacatgtcttttttcttttatcttacagatgatactcgcacacaattttcaagaaatgtttttgaaagttctcctggatagatctgagttcacaccatcttatattttgttggggaatgatggtgcattggacatggattcaacattttaccttttacttcccatcaagcagaaattctatggtgataatatgattgattggccagcagtaaagcggtgtttatcatcacctgcatttcaagatccaatgggtttgtctctgcatgattcatatttaccaaatgagtctttgaagcttcttggtggaacatacaacaaagctgatgtgattggcagtttggtctatactccccacaccgacctgtttttcttcgttgatgccattctggatggaacaaatgctaaaagtgagttgaacggtgcaacgtatgcagaacattttaaacaaaggtaaaatgatgaattatactccctccgttctattttatttgtcacgttttagttcaaaaatgaactagcgggcgacaaatattcgaaaaccgatgtagtatcttacatgccattcctagcttacattttttcttacaaatattgcaaaaatgtactataccatgttgagcgttgagaacaatgctgtatggtcttgtgacagtcagtgtgcgtgtgtgtgcctttcaggcacggtgtacggacatttttctga

SEQ ID NO: 709 - protein, 910 aa, Zea mays
MGSHDGEDEELPPPPPVPPDVIPIKAEDAVGESPANHILKPKRLLMDRPGIGRKGQPTQLYSNHFKVAVKSTEDVFFHYYVNLKYEDDRPVDGKGIGRKVIDKLQQTYRAELSNKDFAYDGEKSLFTVGGLPQKKNEFTVVLEDVSTGKTAANGSPGGNDSPGGGDRKRVRRPYQTKTFKVEINFAAEVPMSAIGQVIRGEESENSLEALRVLDIILRQHSAEQGCLLVKQSFFYNNPSCFVDLGGGVMGCRGFHSSFRGTQSGLSLNVDVSTTMIVKPGPVIDFLLSNQNVNDPSRIDWQKAKRALKGLRIRTTPANSEFKIFGLSERICKEQTFPLRQRNGSNGDCDTIEITVYDYYAKKGIDLKYSGDFPCINTGKAKRPTYFPIELCSLVPLQRYTKALSTLQRSSLVEKSRQKPEERMTVLNDALQRSNYDSDPMLRACGVSVAPKFTQVEGRILQAPKLKAGNGDDIFSRNGRWNFTNRKFYETCSVNKWAVVNFSARCDVRNLIRDLMRNASAKGIQMEEPFDVFEESPSMRRAPVSRRVDDMFGQIKSKLPGAPRFLLCLLPERKNCEIYGPWKRKCLAEFGIVTQCLAPLRVNDPYLLNLLMKINAKLGGLNSLLQVEASSSIPHVSQVPTIILGMDVSHGHPGQDRPSVAAVVSSRQWPLISRYRASVHTQSARLEMMSSLFKPRGTDDDGLIRESLIDFYTSSGKRKPEHIIIFRDGVSESQFTQVINIELDQIIEACKFLDEKWSPKFTVIVAQKNHHTKFFQTASPDNVLPGTVVDSKVCHPKNFDFYMCAHAGMIGTTRPTHYHVLHDEIGFSADEMQEFVHSLSYVYQRSTTAISVVAPVCYAHLAAAQVSTFLRLEEMSDASSSQGGGHTSAGSAPVPELPRLHDKVRSSMFFC

SEQ ID NO: 710 - protein, 633 aa, Zea mays
MGSHDGEDEELPPPPPVPPDVIPIKAEDAVGESPANHILKPKRLLMDRPGIGRKGQPTQLYSNHFKVAVKSTEDVFFHYYVNLKYEDDRPVDGKGIGRKVIDKLQQTYRAELSNKDFAYDGEKSLFTVGGLPQKKNEFTVVLEDVSTGKTAANGSPGGNDSPGGGDRKRVRRPYQTKTFKVEINFAAEVPMSAIGQVIRGEESENSLEALRVLDIILRQHSAEQGCLLVKQSFFYNNPSCFVDLGGGVMGCRGFHSSFRGTQSGLSLNVDVSTTMIVKPGPVIDFLLSNQNVNDPSRIDWQKAKRALKGLRIRTTPANSEFKIFGLSERICKEQTFPLRQRNGSNGDCDTIEITVYDYYAKKGIDLKYSGDFPCINTGKAKRPTYFPIELCSLVPLQRYTKALSTLQRSSLVEKSRQKPEERMTVLNDALQRSNYDSDPMLRACGVSVAPKFTQVEGRILQAPKLKAGNGDDIFSRNGRWNFTNRKFYETCSVNKWAVVNFSARCDVRNLIRDLMRNASAKGIQMEEPFDVFEESPSMRRAPVSRRVDDMFGQIKSKLPGAPRFLLCLLPERKNCEIYGPWKRKCLAEFGIVTQCLAPLRVNDPYLLNLLMKINAKVWDMILSFFCTVLFPGS

SEQ ID NO: 711 - protein, 560 aa, Zea mays
MGSHDGEDEELPPPPPVPPDVIPIKAEDAVGESPANHILKPKRLLMDRPGIGRKGQPTQLYSNHFKVAVKSTEDVFFHYYVNLKYEDDRPVDGKGIGRKVIDKLQQTYRAELSNKDFAYDGEKSLFTVGGLPQKKNEFTVVLEDVSTGKTAANGSPGGNDSPGGGDRKRVRRPYQTKTFKVEINFAAEVPMSAIGQVIRGEESENSLEALRVLDIILRQHSAEQGCLLVKQSFFYNNPSCFVDLGGGVMGCRGFHSSFRGTQSGLSLNVDVSTTMIVKPGPVIDFLLSNQNVNDPSRIDWQKAKRALKGLRIRTTPANSEFKIFGLSERICKEQTFPLRQRNGSNGDCDTIEITVYDYYAKKGIDLKYSGDFPCINTGKAKRPTYFPIELCSLVPLQRYTKALSTLQRSSLVEKSRQKPEERMTVLNDALQRSNYDSDPMLRACGVSVAPKFTQVEGRILQAPKLKAGNGDDIFSRNGRWNFTNRKFYETCSVNKWAVVNFSARCDVRNLIRDLMRNASAKGIVWFSFSHIFYCSSFLLLTFSSGSKWRNLLMCLKRVPL

SEQ ID NO: 712 - protein, 473 aa, Zea mays
MLKACGITIARNFTEVDGRVLQPPKLTAGNGEDIFTRNGRWNFNNKRLIRACSVEKWAVVNFSARCNVRDLVRDLIKCGGMKGIMVDAPFAVFDENPSMRRSPAIRRVEDMFEQVKTKLPGAPKFLLCVLAERKNSDIYGPWKKKCLAEFGIVTQCVAPTRVNDQYLTNVLLKINAKLGGMNSLLQIETSPAIPLVSKVPTIILGMDVSHGSPGHSDVPSIAAVVSSREWPLISKYRASVRTQSPKMEMIDSLFKPREAEDDGLIRECLIDFYTSSGKRKPDQVIIFRDGVSESQFNQVLNIELQQIIEACKFLDEKWNPKFTLIIAQKNHHTKFFIPGKPDNVPPGTVVDNKVCHPKNFDFYMCAHAGMIGTTRPTHYHILHDEIGFSPDDLQELVHSLSYVYQRSTTAISVVAPICYAHLAAAQVGQFIKFDEMSETSSSHGGHTSAGSVPVQELPRLHEKEGSSWYDVKC

SEQ ID NO: 713 - protein, 471 aa, Zea mays
MLKACGITIARNFTEVDGRVLQPPKLTAGNGEDIFTRNGRWNFNNKRLIRACSVEKWAVVNFSARCNVRDLVRDLIKCGGMKGIMVDAPFAVFDENPSMRRSPAIRRVEDMFEQVKTKLPGAPKFLLCVLAERKNSDIYGPWKKKCLAEFGIVTQCVAPTRVNDQYLTNVLLKINAKLGGMNSLLQIETSPAIPLVSKVPTIILGMDVSHGSPGHSDVPSIAAVVSSREWPLISKYRASVRTQSPKMEMIDSLFKPREAEDDGLIRECLIDFYTSSGKRKPDQVIIFRDGVSESQFNQVLNIELQQIIEACKFLDEKWNPKFTLIIAQKNHHTKFFIPGKPDNVPPGTVVDNKVCHPKNFDFYMCAHAGMIGTTRPTHYHILHDEIGFSPDDLQELVHSLSYVYQRSTTAISVVAPICYAHLAAAQVGQFIKFDEMSETSSSHGGHTSAGSVPVQELPRLHEKVRSSMFFC

SEQ ID NO: 714 - protein, 898 aa, Zea mays
MESHNGEADDLPPPPPLAAGVEPLKADETKMPLKPRSLVQRNGFGRKGQQIKLITNHFKVSLMKAEDFFYHYYVNLKYEDDTPVDRKGSGRKVIEKLQQTYAAELANKDFAYDGEKSLFTIGALPQVKMEFTVVDEDVSTGKTPANGSPGNDSPPGSDRKRVRRPYNTKTYKVELSFAAKIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLIANQKVNDPSMIDWAKAKRSLKNLRIKTSPANQEQKIVGLSDRPCREQLFTLKHKNGESEEITVFDYFVKNRGIKLEYSGDLPCINVGKPKRPTYFPVELCSLLPLQRYTKALSTLQRSSLVEKSRQKPQERMSVLSDVLQRSNYDAEPMLKACGITIARNFIEVDGRVLQPPKLKAGNGEDIFTRNGRWNFNNKKLIRASSVEKWAVVNFSARCNVRDLVRDLIKCGGMKGIMVDAPFAVFDENPSMRRSPAVRRVEDMFEQVKTKLPGAPKFLLCVLAERKNSDIYGPWKKKCLAEFGIVTQCVAPTRVNDQYLTNVLLKINAKLGGLNSLLQIETSPAIPLVSKVPTIILGMDVSHGSPGHSDIPSVAAVVSSREWPLISKYRASVRTQSPKMEMIDSLFKPRETDDDGLIRECLIDFYTSSGKRKPDQVIIFRDGVSESQFNQVLNIELQQIIEACKFLDEKWNPKFTLIIAQKNHHTKFFIPGKPDNVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 715 - protein, 560 aa, Zea mays; identical to SEQ ID NO: 711

SEQ ID NO: 716 - protein, 473 aa, Zea mays; identical to SEQ ID NO: 712

SEQ ID NO: 717 - protein, 471 aa, Zea mays; identical to SEQ ID NO: 713

SEQ ID NO: 718 - protein, 296 aa, Zea mays
MEKRTRVGVGSETGTVVYSFGGNKDGHPLQGEYASFSDDNSGGWCLRDKVVGSRCWPLISRYRASVRTQSPKVEMIDSLFKPLDDGKDDGIMRELLLDFYQTSQQRKPKQIIIFRDGVSESQFSQVLNVELNQIIKAYQSMGQGDLPKFTVIIAQKNHHTKLFQADSPENVPPGTVVDSGIVHPRQYDFYMCAHAGPIGTSRPTHYHVLLDEIGFSADNLQKLVLSLSYVYQRSTTAISVVAPICYAHLAAAQMGQFMKFEEFADTSSGSVNSSSPPSIPELPRLHADVCSSMFFC

SEQ ID NO: 719 - protein, 915 aa, Zea mays
MAPSSPSSARPTRASGRKRSAMAEEIHQNQEEEEEVVAASTAKRRRKAASSGKKPKPTPKQAKPAVAGMKKKGETEKTEPVVDDVCAEEPDEEELAMGEEEAEAEEQAMQEVVAAVAAGSPGKKRVGRRSAAASGDHVPEFIGSPVAAAEAHSNWPKRYERSTAANKPEEDDELKARCHYRSAKVDNIVYCLGDDVYVKAGENEADYIGRITEFFEGTDRCHYFTCRWFFRAEDTVINSLVSINVDGHKHDPRRVFLSEEKNDNVLDCIISKVKIVHVDPNMDPKAKAQLIEHCDLYYDMSYSVAYSTFANISSENGQSGSETASGISSDDAGLETSSNMPERTATLLDLYSGCGGMSTGLCLGAALSGLKLETRWAVDLNSFACQSLKYNHPQTEVRNEKADEFLALLKEWAVLCEKYVHQDVDSNLAGSEDQEDADTLDKDEFVVQKLIGIRYDGTGRKKGVYFKVQWEGYGPEEDTWEPIDNLSDCPLKIREFVQEGRKRKILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCMVAYDETQRPSLKKALLLGDAFSDLPKVENHQPNDVMEYGGSPKTEFQRYIRLGRKDMLDWSFGEEAGPDEGKLLDHQPLRLNNDDYERVKQIPVKKGANFRDLKGVKVGANNVVEWDPEVERVYLSSGKPLVPDYAMSFIKGKSLKPFGRLWWDETVPTVVTRAEPHNQVILHPTQARVLTIRENARLQGFPDYYRLFGPIKEKYIQVGNAVAVPVARALGYCLGQAYLGESDGSQPLYQLPASFTSVGRTAVQANAVSVGTPAGEVVEQ

SEQ ID NO: 720 - protein, 849 aa, Zea mays
MAPSSPSSARPTRASGRKRSAMAEEIHQNQEEEEEVVAASTAKRRRKAASSGKKPKPTPKQAKPAVAGMKKKGETEKTEPVVDDVCAEEPDEEELAMGEEEAEAEEQAMQEVVAAVAAGSPGKKRVGRRSAAASGDHVPEFIGSPVAAAEAHSNWPKRYERSTAANKPEEDDELKARCHYRSAKVDNIVYCLGDDVYVKAGENEADYIGRITEFFEGTDRCHYFTCRWFFRAEDTVINSLVSINVDGHKHDPRRVFLSEEKNDNVLDCIISKVKIVHVDPNMDPKAKAQLIEHCDLYYDMSYSVAYSTFANISSENGQSGSETASGISSDDAGLETSSNMPERTATLLDLYSGCGGMSTGLCLGAALSGLKLETRWAVDLNSFACQSLKYNHPQTEVRNEKADEFLALLKEWAVLCEKYVHQDVDSNLAGSEDQEDADTLDKDEFVVQKLIGIRYDGTGRKKGVYFKVQWEGYGPEEDTWEPIDNLSDCPLKIREFVQEGRKRKILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCMVAYDETQRPSLKKALLLGDAFSDLPKVENHQPNDVMEYGGSPKTEFQRYIRLGRKDMLDWSFGEEAGPDEGKLLDHQPLRLNNDDYERVKQIPVKKGANFRDLKGVKVGANNVVEWDPEVERVYLSSGKPLVPDYAMSFIKGKSLKPFGRLWWDETVPTVVTRAEPHNQVILHPTQARVLTIRENARLQGFPDYYRLFGPIKEK

SEQ ID NO: 721 - protein, 915 aa, Zea mays
MAPSSPSPAAPTRVSGRKRAAKAEEIHQNKEEEEEEEEVVAASSAKRSRKAASSGKKPKSPPKQAKPGRKKKGDAEMKEPVEDDVCAEEPDEEELAMGEEEAEEQAMREEVVAVAAGSPGKKRVGRRNAAAAAGDHEPEFIGSPVAADEARSNWPKRYGRSTAAKKPDEEEELKARCHYRSAKVDNVVYCLGDDVYVKAGENEADYIGRITEFFEGTDQCHYFTCRWFFRAEDTVINSLVSISVDGHKHDPRRVFLSEEKNDNVLDCIISKVKIVHVDPNMDPKAKAQLIESCDLYYDMSYSVAYSTFANISSENGQSDSDTASGISSDDVDLETSSSMPTRTATLLDLYSGCGGMSTGLCLGAALSGLKLETRWAVDFNSFACQSLKYNHPQTEVRNEKADEFLALLKEWAVLCKKYVQDVDSNLASSEDQADEDSPLDKDEFVVEKLVGICYGGSDRENGIYFKVQWEGYGPEEDTWEPIDNLSDCPQKIRDFVQEGHKRKILPLPGDVDVICGGPPCQGISGFNRYRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGGAPNAFSQCMVAYDETQKPSLKKALLLGDAISDLPKVQNHQPNDVMEYGGSPKTEFQRYIRLSRKDMLDWSFGEGAGPDEGKLLDHQPLRLNNDDYERVQQIPVKKGANFRDLKGVRVGANNIVEWDPEIERVKLSSGKPLVPDYAMSFIKGKSLKPFGRLWWDETVPTVVTRAEPHNQVIIHPTQARVLTIRENARLQGFPDYYRLFGPIKEKYIQVGNAVAVPVARALGYCLGQAYLGESEGSDPLYQLPPSFTSVGGRTAGQARASPVGTPAGEVVEQ

SEQ ID NO: 722 - protein, 595 aa, Zea mays
MTTLRCCEDFSMERLELLGDSVLKYAVSAHLFMTFLNKHEGQLSSRRQETICNATLYRLGIERRIQGYIRDAAFDPRRWLAPGQLSRRPCPCECPVNSEVVTEDIHRIDDKSIIIGKACDKGHRWICSKTISDCVEALIGAYYVEGGLKAAFAVLKWFQIETEIEEELIMEALSSASVRNYLPKVDVVELLEAKLGYTFQMKGLLIEALTHSSQQESGATYCYQRLEFLGDAVLDILITRHLFLSHKDTDEGELTDLRSASVNNENFAQVAVKHNLHQFLQHSSGFLQDQITEYVNSLESSSMDRASLLSSGPCRGPKVLGDIVESIAGAILIDSKLDLDLVWRVFKPLLSPIVTPENLELPRFRELNEWSDKNGYFIGIKCENRGDSTMAILNLQLKDLLLVRQGCGKNKVDAKAHAASLLLRDLEEKGLIIPRNASRVEQLEKNSGTVKHCNNVLDVMDTQNVAPPRQKEVAVLSTTTPGSVLDKPLVVKVKLSKGGPRISLYESCKKLQWPMPTFEFVKVEPSVCSSSCGSSQKVAPQGFAFASTITLHIPNGDVISLTGDGRADKKSSQDSAALLMLYELQRQRRFQVQEV

SEQ ID NO: 723 - protein, 1517 aa, Zea mays
MADAATSEDADLPPPPPPAQLPPPRRPHKRLQPRGYQVEVFAAALRGNTIAVLDTGSGKTMVAIMLAREHVLRARAGEALRRIVVFLAPTVHLVHQQFEVIREYTDLDAVECHGASGVGHWNAKRWKEAIGTKEIVVMTPQILLDALRHAFLTMRVMSLLIFDECHRACGNHPYSLIMKEFYIDSEWRPAIFGMTASPVSKKGASTIEDCEAQIAQLELVLDAKVYIVEDRNELESFSTGAKVVNKYYDPYLFDLDNLESKLQMLFEEVVKIYNESINTIDDSEDCVFSKESLNLQVSYFKEALFLIEDFLPQGYGELMKSESGSAELTKKGYISSKVESLINIFKSFGSSEEVLCMIFVERITTAKAVERFMRGNVNFSRFSISYLTGGSTSKDALSPAVQRFTLDLFRAGKVNLLFTTDVTEEGIDVPNCSCVIRFDLPRTVCSYVQSRGRARKSSSSYVLMIERGNLAQQEHIFRIIRTEYYVKTFALHKQPNTPSLDLPLQEKYIYHVESTGATITAECCVNLIYKYCEKLPKDRYYLPKPCFEVGLKDGSYQCTLTMPHNAAFRSIVGPPSSSCNLAKQLVCLEACKKLHELGELDDHLVPLTEEPMDIDTDTTDKKCVSGPGTTKRKELHGTINVHGLSGNWIHESETVILNAYTFDFRCDQEGELYAGFVLLMESVLDDDVARSEIDLFLIPNKMVYTTMTPCGKIQLNKEQLCKGKLFQEFFFNGIFGRLFHGSRTDELQREFIFTKGHEIQWGSDNMYLLLPLRNSSQIQHDPNIYWEAVESCSGTVEQLRNLYLEDGNLNHENLCSHKRSNKGEDIIHLANKSLHFSTVKDSVVLSLHTGRIYSVLDLILDKTADDSFDEMYNGKASPFASFVDYYHQKYGIVIQHPGQPLLLLKQSHNAHNLLFSKMKYQDGSTGNPLLVEKEQIHARVPPELLIHIDVATDILKSFYLLPSVMHRVQSLMLASQLRSNISYIQRIPSSLILEAITTLRCCESFSLERLELLGDSVLKYVIGCDLFLRYPMKHEGHLSDMRSKAVCNATLHKHGIWQSLQGYIRDAAFDPRRWVAPGQISLRPFPCNCGIETAFVPFNGGYISDDPSFVVGKPCDRGHRWMCSKTVSDCVEALVGAYYVGGGIAAAIWVMRWFGIDVRCDMELVQKAKYNSNASRMCYLSKIKDIEELEAKLKYNFSVKGLLLEAISHPSVQELGVDYCYQRLEFLGDSVLDLLITQHLYATHTDVDPGELTDLRSASVSNENFAQAVVRNNIHNHLQHGSGILLEQVTEYVRSNLEYHGKENQFLQQATCKAPKVLGDIMESITGAIFIDVNFDVDLVWKIVEPLLSPMITPDKLALPPYRELLELCSHLGCFIESKCTSEGEELIIEMKVQLRDEQLIAQGHDRNGKTAKANAAARILVDMKKRGLSLKQCISKANQLDIVSSKLQSELTNLESRHDCPHMNGTLSLGLSSARAAVVLPLKMDKGGPRTALFRLCKSLQWPIPEFEFVEQRFRY

SEQ ID NO: 724 - protein, 1440 aa, Zea mays
MADAATSEDADLPPPPPPAQLPPPRRPHKRLQPRGYQVEVFAAALRGNTIAVLDTGSGKTMVAIMLAREHVLRARAGEALRRIVVFLAPTVHLVHQQFEVIREYTDLDAVECHGASGVGHWNAKRWKEAIGTKEIVVMTPQILLDALRHAFLTMRVMSLLIFDECHRACGNHPYSLIMKEFYIDSEWRPAIFGMTASPVSKKGASTIEDCEAQIAQLELVLDAKVYIVEDRNELESFSTGAKVVNKYYDPYLFDLDNLESKLQMLFEEVVKIYNESINTIDDSEDCVFSKESLNLQVSYFKEALFLIEDFLPQGYGELMKSESGSAELTKKGYISSKVESLINIFKSFGSSEEVLCMIFVERITTAKAVERFMRGNVNFSRFSISYLTGGSTSKDALSPAVQRFTLDLFRAGKVNLLFTTDVTEEGIDVPNCSCVIRFDLPRTVCSYVQSRGRARKSSSSYVLMIERGNLAQQEHIFRIIRTEYYVKTFALHKQPNTPSLDLPLQEKYIYHVESTGATITAECCVNLIYKYCEKLPKDRYYLPKPCFEVGLKDGSYQCTLTMPHNAAFRSIVGPPSSSCNLAKQLVCLEACKKLHELGELDDHLVPLTEEPMDIDTDTTDKKCVSGPGTTKRKELHGTINVHGLSGNWIHESETVILNAYTFDFRCDQEGELYAGFVLLMESVLDDDVARSEIDLFLIPNKMVYTTMTPCGKIQLNKEQLCKGKLFQEFFFNGIFGRLFHGSRTDELQREFIFTKGHEIQWGSDNMYLLLPLRNSSQIQHDPNIYWEAVESCSGTVEQLRNLYLEDGNLNHENLCSHKRSNKGEDIIHLANKSLHFSTVKDSVVLSLHTGRIYSVLDLILDKTADDSFDEMYNGKASPFASFVDYYHQKYGIVIQHPGQPLLLLKQSHNAHNLLFSKMKYQDGSTGNPLLVEKEQIHARVPPELLIHIDVATDILKSFYLLPSVMHRVQSLMLASQLRSNISYIQRIPSSLILEAITTLRCCESFSLERLELLGDSVLKYVIGCDLFLRYPMKHEGHLSDMRSKAVCNATLHKHGIWQSLQGYIRDAAFDPRRWVAPGQISLRPFPCNCGIETAFVPFNGGYISDDPSFVVGKPCDRGHRWMCSKTVSDCVEALVGAYYVGGGIAAAIWVMRWFGIDVRCDMELVQKAKYNSNASRMCYLSKIKDIEELEAKLKYNFSVKGLLLEAISHPSVQELGVDYCYQRLEFLGDSVLDLLITQHLYATHTDVDPGELTDLRSASVSNENFAQAVVRNNIHNHLQHGSGILLEQVTEYVRSNLEYHGKENQFLQQATCKAPKVLGDIMESITGAIFIDVNFDVDLVWKIVEPLLSPMITPDKLALPPYRELLELCSHLGCFIESKCTSEGEELIIEMKVQLRDEQLIAQGHDRNGKTAKANAAARILVDMKVYLFKQKQNIKKCLV

SEQ ID NO: 725 - protein, 1199 aa, Zea mays
MKSESGSAELTKKGYISSKVESLINIFKSFGSSEEVLCMIFVERITTAKAVERFMRGNVNFSRFSISYLTGGSTSKDALSPAVQRFTLDLFRAGKVNLLFTTDVTEEGIDVPNCSCVIRFDLPRTVCSYVQSRGRARKSSSSYVLMIERGNLAQQEHIFRIIRTEYYVKTFALHKQPNTPSLDLPLQEKYIYHVESTGATITAECCVNLIYKYCEKLPKDRYYLPKPCFEVGLKDGSYQCTLTMPHNAAFRSIVGPPSSSCNLAKQLVCLEACKKLHELGELDDHLVPLTEEPMDIDTDTTDKKCVSGPGTTKRKELHGTINVHGLSGNWIHESETVILNAYTFDFRCDQEGELYAGFVLLMESVLDDDVARSEIDLFLIPNKMVYTTMTPCGKIQLNKEQLCKGKLFQEFFFNGIFGRLFHGSRTDELQREFIFTKGHEIQWGSDNMYLLLPLRNSSQIQHDPNIYWEAVESCSGTVEQLRNLYLEDGNLNHENLCSHKRSNKGEDIIHLANKSLHFSTVKDSVVLSLHTGRIYSVLDLILDKTADDSFDEMYNGKASPFASFVDYYHQKYGIVIQHPGQPLLLLKQSHNAHNLLFSKMKYQDGSTGNPLLVEKEQIHARVPPELLIHIDVATDILKSFYLLPSVMHRVQSLMLASQLRSNISYIQRIPSSLILEAITTLRCCESFSLERLELLGDSVLKYVIGCDLFLRYPMKHEGHLSDMRSKAVCNATLHKHGIWQSLQGYIRDAAFDPRRWVAPGQISLRPFPCNCGIETAFVPFNGGYISDDPSFVVGKPCDRGHRWMCSKTVSDCVEALVGAYYVGGGIAAAIWVMRWFGIDVRCDMELVQKAKYNSNASRMCYLSKIKDIEELEAKLKYNFSVKGLLLEAISHPSVQELGVDYCYQRLEFLGDSVLDLLITQHLYATHTDVDPGELTDLRSASVSNENFAQAVVRNNIHNHLQHGSGILLEQVTEYVRSNLEYHGKENQFLQQATCKAPKVLGDIMESITGAIFIDVNFDVDLVWKIVEPLLSPMITPDKLALPPYRELLELCSHLGCFIESKCTSEGEELIIEMKVQLRDEQLIAQGHDRNGKTAKANAAARILVDMKKRGLSLKQCISKANQLDIVSSKLQSELTNLESRHDCPHMNGTLSLGLSSARAAVVLPLKMDKGGPRTALFRLCKSLQWPIPEFEFVEQRFRY

SEQ ID NO: 726 - protein, 609 aa, Zea mays
MAHWVSDSDGSDNFEWDSDGNGEEPANFNAAGAGSSALRSTNTDAPGPSTRVANGNGKAGPSASLVQKYMDMGFTEEIVRKAMKDNGDNGADSLVELLLTYQELGNDLKVDNGFASGCAPQTVDDSDDDDILENWDDEDADGGRSTRVANSIDDSEDEDFLNEMSQKDKKVDSLVKMGFPEDEAALAITRCGQDASISVLVDSIYASQTAGDGYCGNLSDYEGNSNGGRNKGRFMDGNKKKRKRYGGQAQGNRGPLDGSCEEPMPLPNPMVGFNLPDHWTRPVDRSLPTQAIGPPYFYYENVALAPKGVWTTISRFLYDIQPEFVDSKYFCAAARKRGYIHNLPLERRSPLLPLPPKTIFEAFPRTKRWWPSWDPRRQFNCLQTCTSSAKLLERIRVTLANSSDPPPPLVQKFVLEECRKWNLAWVGLNKVAPLEPDEMEFLLGFPKDHTRGISRTERYRSLGNSFQVDTVAYHLSVLKDRYPQGMNVLSLFTGIGGAEVALHRLGIRMNTVVSVEKSEVNRTILKSWWDQTQTGTLIEINDVQTLTADRIEAYIRRIGGFDLVIGGSPCNNLAGSNRHHRDGLEGEHSSLFYHYFRILDSVKSIMERL

SEQ ID NO: 727 - protein, 685 aa, Zea mays
MDLDMDGYVDPYEEAAAEGDSDDPDEDDSDAESDYEEKSFGLLKSGKHRVRNPDGTFRCPFCLGKKKQGYKIKDLLQHADGIGVSSKHRRHGRERANHRAFARFVRTDPSFAEDLVGITGIQGAITTTPANENYSANGNGKAKANVDTAGSSSVAAKVGPPQEVERFAWPWACVLAAGAGFNAEDFVGRVALFSSVEVVPLFVDEMEVTETFAIVRFTNDWSGFNDALTIENYFSVNKLGKKEFQMRDSGLGSVEGDGEGDVKVYGWVARAEDYDATTVVGRFLRKHTVLQTIDEVSKTELEKSGEMVAILASQIEEKNRYLQDLETKKNATELSISRLEEDNRKLHEAYNEEMRNLHRRARENALRIFQENENLRIDLENKRRELNLRAKELEKMSAENANDRKTLDDQKQKTKYDNSELELASIEQQRADADVLKLLADQEREKEDVLARMLQLEKELHEKQQLELEVERLNGTLQVMKHLEGDDDGGDIHEKMEKLSERFEREKKRLEDLSGDLVTKERESNDELQQARKELIKGLEEELNGRTAVGIKRMGELDEKPFLNACKRKYGNNEYQVKAAELVTNWQEELKNPSWYPFKMIHVDGEDKEILVDDDTKLKFLWIEFGDDVCNAVKTALMEINEYNPSGRYVVPELWNFRKGRKATMKEVLKYLFSQMDTTTKRRRG

SEQ ID NO: 728 - protein, 691 aa, Zea mays
MDLDLDDYVDPYEEAEAEAAAAEDGSDDPDEDDSDAESDYEEESFGLLKSGKHRVRNPDGTFRCPFCPGKKKQGYKIKDLLQHADGIGVSSKHRRHGRERANHRAFARFVRTEPSFAEDLVGITGIQGAIKPTPANRDGSTNGDGKAKANVDTAGSSSVAAKVGLPREVERFSWPWACVLAAGAGFNTEDFAGRVAMFSSVEVVPLFVDEVEVAETFAVVRFTNDWSGFSDALTLENHFSINKLGKKEFEMRDNGIGSVEGDGGEGEVKVYGWVARAEDYDSPSVVGRFLRKHTVLKTIDEVSKTELEKSGEMVAILASKIEEKNRHLQDLETKKNATELSISRLEEDNRKLHEAYNEEMRNLHRRARENALRIFQENENLRIDLESKKRELNLRAKELDKISTENANDRKTLDNEKQKAKYDNSELELASIEQQRADADVLKLLADQEREKEDVLARMLQLEKELHEKQQLELEVERLNGTLQVMKHLEGDDDGGDIHEKMEKLSERFEREKKRLEELSGDLVRKERESNDELQEARKELIKGLEEELNGRTAIGVKRMGELDEKPFQNACKTKYGKDEYEIKAAELVTSWQDELKKPSWHPFKMVEVNGENKEILDDDDTKLKFLWIEYGDDVCNAVKTALMEINEYNPSGRYVVPELWNFRKGRKATVKEVLKYLFSQMDTTTKRRRG

SEQ ID NO: 729 - protein, 1536 aa, Zea mays
MLTNDFSGTRRCRAKPQKKEEESTENNKLENGSLDATEEVHHGVEKGDGHVTRKRPRRSAACSDFKEKSIRLSEKKSVVMVKKNRMEEEEVDAVNLTKLGPEDPPPCRKLIDFILHDAEGNPQPFEMSEIDDFFITALIMPMDDDLEKERERGVRCEGFGRIEDWNISGYDEGTPVIWVSTDVADYECVKPSTNYKSYFDHFYEKAQVCVEVFKKLAKSVGGNPNQGLDELLASVVRSTNAMKGYSGTMSKDLVISIGEFVYNQLVGLDETSNNDDEKFATLPVLLSLRDQCRSRVELTKLPSNFSNTSLKIKDSECDETAEDDDDAKLARLLQQEEEWKMMKKQRGRRGTPSQKNVYIKISEAEIANDYPLPAYYKPFSQEMDEYIFDSDDSIFSDDVPVRILNNWTLYNADSRLISLELIPMKSGAENDVVIFGSGFMRDDDGSCCSTAESVKSSSSSSKADQLDAGIPIYLSPIKEWIIEFGGSMICITIRTDVAWYKLRQPTKQYAPWCEPVLKTARLAVSIITLLKEQSRASKLSFADVIRKVAEFDKGNPAFISSNITLVERYIVVHGQIILQQFADFPDETIRRSAFVSGLLLKMEQRRHTKLVMKKKTQVMRGENLNPSAAMGPASRKKAMRATTTRLINRIWSDYYAHHFPEDSKEGDGNETKEIDDEQEENEDEDAEDEGQIEENISKTPPSTRSRKLLSQTCKEIRWEGETSGKTLSGETLYKCAYVRELRIPVGGTVALEDDSGDTVICFVEYMFQKVDGSKMVHGRILQKGSQTILGNAANEREVFLTNDCLEFKLDDIKELVMVDIQSRPWGHKYRKENSEADKVEQVKAEERKKKGQPMVYFCKSLYWPEKGAFFALSRDKMGLGSGLCSSCDNIEPDSDELKIFSKTSFVYRKVTYNVNEFLYIRPDFFAEDEDRATFKAGRNVGLKPYAVCQILSIPEGAGSKKLNPASANISARRFYRPDDISSAKAYASDIREVYYSEDVIDVPVDMIEGKCEVRKKNDLASSDLPVMFEHVFFCELIYDRASGALKQLPPNVRFMSMVQRTSALKKNKGKQICEPDQIDSGKWLDVPKENRLATLDIFAGCGGLSEGLQQAGVSFTKWAIEYEEPAGEAFNKNHPEAVVFVDNCNVILKAIMDKCGDTDDCVSTSEAAEQAAKLPEVNINNLPVPGEVEFINGGPPCQGFSGMNRFNQSPWSKVQCEMILAFLSFAEYFRPRFFLLENVRNFVSFNKGQTFRLAVASLLEMGYQVRFGILEAGAFGVAQSRKRAFIWAAAPGEMLPDWPEPMHVFASPELKITLPDGQYYAAARSTAGGAPFRAITVRDTIGDLPKVGNGASKLTLEYGGEPVSWFQKKIRGNMMVLNDHISKEMNELNLIRCQHIPKRPGCDWHDLPDEKVKLSNGQMADLIPWCLPNTAKRHNQWKGLYGRLDWEGNFPTSVTDPQPMGKVGMCFHPDQDRIITVRECARSQGFPDSYEFAGNIQNKHRQIGNAVPPPLAYALGRKLKEAVDKRQEASAGVPAP

SEQ ID NO: 730 - protein, 1115 aa, Zea mays
MLTNDFSGTRRCRAKPQKKEEESTENNKLENGSLDATEEVHHGVEKGDGHVTRKRPRRSAACSDFKEKSIRLSEKKSVVMVKKNRMEEEEVDAVNLTKLGPEDPPPCRKLIDFILHDAEGNPQPFEMSEIDDFFITALIMPMDDDLEKERERGVRCEGFGRIEDWNISGYDEGTPVIWVSTDVADYECVKPSTNYKSYFDHFYEKAQVCVEVFKKLAKSVGGNPNQGLDELLASVVRSTNAMKGYSGTMSKDLVISIGEFVYNQLVGLDETSNNDDEKFATLPVLLSLRDQCRSRVELTKLPSNFSNTSLKIKDSECDETAEDDDDAKLARLLQQEEEWKMMKKQRGRRGTPSQKNVYIKISEAEIANDYPLPAYYKPFSQEMDEYIFDSDDSIFSDDVPVRILNNWTLYNADSRLISLELIPMKSGAENDVVIFGSGFMRDDDGSCCSTAESVKSSSSSSKADQLDAGIPIYLSPIKEWIIEFGGSMICITIRTDVAWYKLRQPTKQYAPWCEPVLKTARLAVSIITLLKEQSRASKLSFADVIRKVAEFDKGNPAFISSNITLVERYIVVHGQIILQQFADFPDETIRRSAFVSGLLLKMEQRRHTKLVMKKKTQVMRGENLNPSAAMGPASRKKAMRATTTRLINRIWSDYYAHHFPEDSKEGDGNETKEIDDEQEENEDEDAEDEGQIEENISKTPPSTRSRKLLSQTCKEIRWEGETSGKTLSGETLYKCAYVRELRIPVGGTVALEDDSGDTVICFVEYMFQKVDGSKMVHGRILQKGSQTILGNAANEREVFLTNDCLEFKLDDIKELVMVDIQSRPWGHKYRKENSEADKVEQVKAEERKKKGQPMVYFCKSLYWPEKGAFFALSRDKMGLGSGLCSSCDNIEPDSDELKIFSKTSFVYRKVTYNVNEFLYIRPDFFAEDEDRATFKAGRNVGLKPYAVCQILSIPEGAGSKKLNPASANISARRFYRPDDISSAKAYASDIREVYYSEDVIDVPVDMIEGKCEVRKKNDLASSDLPVMFEHVFFCELIYDRASGALKQLPPNVRFMSMVQRTSALKKNKGKQICEPDQIDSGKWLDVPKENRLATLDIFAGCGGLSEGLQQAGMYC

SEQ ID NO: 731 - protein, 1536 aa, Zea mays
MLTNDFSGTRRCRAKPQKKEEESTENNKLENGPLDATEEVHHGVEKGDGHVTRKRPRRAAACSDFKEKSIRLSEKKSVVMVKKNRMEEEEVDAVNLTKLGPEDPPPCRKLIDFILHDAEGNPQPFEMSEIDDFFITALIMPMDDDLEKEREKGVRCEGFGRIEDWNISGYDEGTPVIWVSTDVADYECVKPSTNYKSYFDHFYEKAQVCVEVFKKLAKSVGGNPNQGLDELLASVVRSTNAMKGYSGTMSKDLVISIGEFVYNQLVGLDETSNNDDEKFATLPVLLSLRDQCRSRVELTKLPSNFSNTSLKIKDSECDETAEDDDDAKLARLLQQEEEWKMMKKQRGRRGTPSQKNVYIKISEAEIANDYPLPAYYKPFSQEMDEYIFDSDDSIFSDDVPVRILNNWTLYNADSRLISLELIPMKSGAENDVVVFGSGFMRDDDGSCCSTAESVKSSSSSSKADQLDAGIPIYLSPIKEWIIEFGGSMICITIRTDVAWYKLRQPTKQYAPWCEPVLKTARLAVSIITLLKEQSRASKLSFADVIRKVAEFDKGNPAFISSNITLVERYIVVHGQIILQQFADFPDETIRRSAFVSGLLLKMEQRRHTKLVMKKKTQVMRGENLNPSAAMGPASRKKAMRATTTRLINRIWSDYYAHHFPEDSKEGDGNEIKEIDDEQEENEDEDAEDEGQIEENISKTPPSTRSRKLLSQTCKEIRWEGETSGKTLSGETLYKCAYVRELRIPVGGTVALEDDSGDTVMCFVEYMFQKVDGSKMVHGRILQKGSQTILDNAANEREVFLTNDCLEFKLDDIKELVMVDIQSRPWGHKYRKENSEADKVEQVKAEERKKKGQPMVYFCKSLYWPEKGAFFALSRDKMGLGSGLCSSCDNIEPDSDELKIFSKTSFVYRKVTYNVNEFLYISPDFFAEDEDRATFKAGRNVGLKPYAVCQILSIPEGAGSKKLNPASANISARRFYRPDDISSAKAYASDIREVYYSEDVIDVPVDMIEGKCEVRKKNDLASSDLPVMFEHVFFCELIYDRASGALKQLPPNVRFMSMVQRTSALKKNKGKQICEPDQIDSGKWLDVPKENRLATLDIFAGCGGLSEGLQQAGVSFTKWAIEYEEPAGEAFNKNHPEAVVFVDNCNVILKAIMDKCGDTDDCVSTSEAAEQAAKLPEVNINNLPVPGEVEFINGGPPCQGFSGMNRFNQSPWSKVQCEMILAFLSFAEYFRPRFFLLENVRNFVSFNKGQTFRLAVASLLEMGYQVRFGILEAGAFGVAQSRKRAFIWAAAPGEMLPDWPEPMHVFASPELKITLPDGQYYAAARSTAGGAPFRAITVRDTVGDLPKVGNGASKLTLEYGGEPVSWFQKKIRGNMMVLNDHISKEMNELNLIRCQHIPKRPGCDWHDLPDEKVKLSNGQMADLIPWCLPNTAKRHNQWKGLYGRLDWEGNFPTSVTDPQPMGKVGMCFHPDQDRIITVRECARSQGFPDSYEFAGNIQNKHRQIGNAVPPPLAYALGRKLKEAVDKRQEASAGVPAP

SEQ ID NO: 732 - protein, 1115 aa, Zea mays
MLTNDFSGTRRCRAKPQKKEEESTENNKLENGPLDATEEVHHGVEKGDGHVTRKRPRRAAACSDFKEKSIRLSEKKSVVMVKKNRMEEEEVDAVNLTKLGPEDPPPCRKLIDFILHDAEGNPQPFEMSEIDDFFITALIMPMDDDLEKEREKGVRCEGFGRIEDWNISGYDEGTPVIWVSTDVADYECVKPSTNYKSYFDHFYEKAQVCVEVFKKLAKSVGGNPNQGLDELLASVVRSTNAMKGYSGTMSKDLVISIGEFVYNQLVGLDETSNNDDEKFATLPVLLSLRDQCRSRVELTKLPSNFSNTSLKIKDSECDETAEDDDDAKLARLLQQEEEWKMMKKQRGRRGTPSQKNVYIKISEAEIANDYPLPAYYKPFSQEMDEYIFDSDDSIFSDDVPVRILNNWTLYNADSRLISLELIPMKSGAENDVVVFGSGFMRDDDGSCCSTAESVKSSSSSSKADQLDAGIPIYLSPIKEWIIEFGGSMICITIRTDVAWYKLRQPTKQYAPWCEPVLKTARLAVSIITLLKEQSRASKLSFADVIRKVAEFDKGNPAFISSNITLVERYIVVHGQIILQQFADFPDETIRRSAFVSGLLLKMEQRRHTKLVMKKKTQVMRGENLNPSAAMGPASRKKAMRATTTRLINRIWSDYYAHHFPEDSKEGDGNEIKEIDDEQEENEDEDAEDEGQIEENISKTPPSTRSRKLLSQTCKEIRWEGETSGKTLSGETLYKCAYVRELRIPVGGTVALEDDSGDTVMCFVEYMFQKVDGSKMVHGRILQKGSQTILDNAANEREVFLTNDCLEFKLDDIKELVMVDIQSRPWGHKYRKENSEADKVEQVKAEERKKKGQPMVYFCKSLYWPEKGAFFALSRDKMGLGSGLCSSCDNIEPDSDELKIFSKTSFVYRKVTYNVNEFLYISPDFFAEDEDRATFKAGRNVGLKPYAVCQILSIPEGAGSKKLNPASANISARRFYRPDDISSAKAYASDIREVYYSEDVIDVPVDMIEGKCEVRKKNDLASSDLPVMFEHVFFCELIYDRASGALKQLPPNVRFMSMVQRTSALKKNKGKQICEPDQIDSGKWLDVPKENRLATLDIFAGCGGLSEGLQQAGMYC

SEQ ID NO: 733 - protein, 1030 aa, Zea mays
MAKPEEKLRCTKEPFIEDVGTRRIKSIRFSVLSGSEIRKSAEVQVWNNRIYDRDMTPVPNGLLDPRMGIPTKRGKCNTCHGEFSDCPGHFGYLKLALPVFNVGFFNCILDVLKCICKSCSRVLLIEKDRREFLKKMRNPRADALQKSATMKKVRDKCKLSCCPRCDYRNGVVKKGRAGLIVVHDCSKVLDGHTEELKNALQNKKEKVSASSVLVLDPATVLSLFRRMIDEDCELLNLGDRPEKLIVTEIAVPPVPIRPSVVVGNSRTSNEDSITVILKSIVNTNSILKETLHTGGPFTKCFDCWQYLQLQVVEYVNSDAPSLPESQHRGLVQRLKGKTGRFRGNLSGKRTEYTGRTVISPDPNLKITEVAIPVLMARVLTYPERVSNYNIEKLRQCIRNGPFKYPGANFVTQPDGMKQSLKYGDRRITARDLKCGCIVERHLEDGDVVLFNRQPSLHRMSIMCHRARIMPWRTLRFNESVCNPYNADFDGDEMNLHVPQTEEARTEALMLMGVQNNLCTPKNGEILVASTQDFLTSSFLVTRKDTFYDRSSFTLLCSYLGDGMENIDLPTPALIKPVELWTGKQLFSVLVRPNAHTKVFLNLAVQEKIYSKKKGKKEGGEEVKETMCGRETMCPNDGYVYFRNSELLSGQVGKATLGNGNKDGLYSVLLRDYNSHAAASCMNRLAKFSARFIGNHGFSIGVDDVQPGEHLNRQKKKEIDGGYKKCHDLISLFAKGALALHPGCNAAQTLEHNITGVLNEIRSIAGNVCMDTLHWRNSPLIMSQCGSKGSPINISQMVACVGQQSVGGRRAPDGFLNRTLPHFPINSKTPAAKGFVANSFYTGLTATEFFFHTMGGREGLVDTAVKTAETGYMSRRLMKGLEDLSVFYDQTVRNASGGIVQFLYGDDGMDPAKMEGKDGMPLNLDQLFMKVMATCPQRGSDTLSPVGIKQMLEDKFLQHDTSSDGGCSAEFKKNLTEFLDKRIELMKCTRRALHLHEDHVEKKDSCLEESIAAIISGISAKQLQVRVYNLL

SEQ ID NO: 734 - protein, 1444 aa, Zea mays
MELHREPPEAILNAIKFDLMTSTDMEKLSSMSIIEVSDVTSPKLGLPNGSLQCETCGSQRGRDCDGHFGVTKLAATVHNPYFIDDVVHFLNRICPGCLSPREGIDTKRLEREKVQATCKYCSKDGSKLYPSIVFKTLSSPRVLLFKSKLHRNASVMERISIVAEAADRMPNRSKGKGSLEGLPLDFWDFVPSENKQVQSNMTKIILSPYQVFYMLKKSDPELIKQFVSRRELLFLSCLPVTPNCHRVVEIGYGLPDGRLTFDDRTKAYKRMVDVSRRIDDYRQHPHFSVLASSLVSSRVSECLKSSKLYSKKADGETSTDTYGMKWLKDVVLSKRSDNVFRSIMVGDPKIKLWEIGIPEDLSSSLVVSEHVSSYNFQSTNLKCNLHLLAKQELFIRRNGKLMFLRKADQLEIGDIAYRPLQDGDIILINRPPSVHQHSLIALSAKILPIHSVVSINPLCCTPFAGDFDGDCLHGYIPQSIRSRVELEELVSLHNQLLNMQDGRNLVSLTHDSLAAAHLLTSTDVFLKKSELQQLQMLCLSVSTPAPAVIKSMNFQGSLWTGKQLFSMLLPSGMNFSCDTELHIMDSEVLTCSLGSSWLQNNTSGLFSVMFKQYGCKALDFLSSAQEVLCEFLTMRGLSVSLSDLYMFSDHYSRRKLAEGVKLALYEAEEAFRVKKILLDPINIPVLKCHDETEDVTYRQSDCIQSNPSVIRSSIMAFKDVFRDLLKMVQQHVSNDNSMMVMINAGSKGSMLKYAQQTACIGLQLPASKFPFRIPSQLSCISWNGQKSLNYEAESTSERVGGQNLYAVIKNSFIEGLNPLECLLHAISGRANFFSENADVPGTLTRKLMYHLRDIHVAYDGTVRSSYGQQIVQFSYDSVDDLVDKLGAPVGCRAACSISEAAYGALEHPVNGLEDSPLMNLQEVFKCHKATNSGDHIGLLFLSRHLKKYRYGLEYASLEVKNHLERVNFSDLVETIMIIYDGHDKIRNEGMWTTHFHINKAMMKKKRLGLRFVVDELAKEYDTTRDQLNNAIPSIRISRRKCLVGDEGVKSSSCCIAVVAHAERNSISQLDTIKTRVIPSILDTLLKGFLEFKDVEIQCPHDGELLVKVCMSEHCKGGRFWPTLQNACIPVMELIDWELSQPSNVSDIFCSYGIDSAWKYFVESLKSATTDTGRNIRREHLLVIADSLSVTGQFHALSSQGLKQQRTRLSISSPFSEACFSRPAQSFINAAKQCSVDNLCGSLDAVAWGKEPFNGTSGPFEIMHSGKPHEPEQNESIYDFLCSSKVRNFEKNHLDTRRQSTENASICRLACKSSKGSTTVNGVAITIDQDFLHAKVSIWDNIIDMRTSLQNMLREYPLNGYVAEPDKSQLIEALKFHSRGAEKIGVGVREIKIGLNPSHPGTRCFILLRNDDTTEDFSYHKCVQGAADSISPQLGSYLKKLYYRA

SEQ ID NO: 735 - protein, 1444 aa, Zea mays; identical to SEQ ID NO: 734

SEQ ID NO: 736 - protein, 896 aa, Zea mays
MDNTHHLWPAEAHGAAGGESHPDHALQPAPRQPIPGPAPAGRRQLRVLLLQRHAARQLRRAFRLHQAAGAHLPPQSHHRAGKILNLVCLRLKKPKQKDTGKECRFTSCSYCQHIPDVKKVQSGSLLCLNNEIVLLLQTPAFLLFQDLPPLCVSQVKKFNGARSLELKAPLKQEVAVRFWSFLDQFGFHTSGTSHRRPLHPKEDGYVMDNMSVPPNCLHVSNILDDNTEMCPPDTPKGLLRKILRTIEQIKSLNISQTRELGADDLQVAVGDYMDMGGPAEVFQHVTFTRQPAPKQWHKKMKALFLSKSSSYSCRAVITGDPYIGLDVVGVPDEVARRMTVQECVTNYNIARLQDMMEKGLCLTYTDLNTNTYDLDGKKGNKKCIMPRVGETVERRVLDGDLVFLNRPPSTDMHSVQALYVHVHDDHTIKINPLICGPLGADFDGDCVHIFSPRSVPGRVEAAELFTVEKQLLNSHNAKLNFQIKNDYLLALKIMCVRSYSREKASQIAMFSSGMILPGDWTIPQILQTTDALRTLPSHPNKQSVGASVTAIISSTLSEKGPRGAIKLINLLQPLLMESLLMDGFSISLKGLDGRCAMQKANQSSSLETDKFNKLTVDSIVNSSALGLLVDPKKDSTLKKLVEQIGFLGQQLQRTGRLYSSNLVEDCYNFLERCSGSTKCYDPSKGHDFVTSSFYNGLNPYEELLHSISVREKIERSSSKGLAESGNLFKNMMAMLRDVTVCYDGTMRTSCSNSIVQFDSTNVSSSVTPGDPVGILAATAFVNAAYKAVLDPVFGHSVEHPPGAQNPRMIASRRQGHMNVASLGALQLRLGSAAPPSSAMAAFSSGNSGRSGWPASGSKTSSSLEPKKKSELTGGHRGEEEREQLLVRENFPAAEYV

SEQ ID NO: 737 - protein, 554 aa, Zea mays
MRTLFISKGSGFSSRSVLTGDPYIGLGVVGLPSEVAKRMTFEEQVTDININRLQDVVDKGLCLTYRDGQATYAITVGSKGYTTLKVGQTISRRIVDGDVVFLNRPPSTHKHSLQAFYAYVHDDHTVKINPLMCGPFSADFDGDCVHIYYPQSLAAKAEALELFSVERQLISSHSGKVNLQLGNDSLVAMKAMSHTTMLHKELANQLAMFVPFSLLAPAVIKPVPSWTISQIVQGAFPANLTCQGDTHLVRDSTIIRLDLGKESVQDSFPDLVSSILREKGPKEALQFLNVLEPLLMEFLLLDGLSISLRDFNVPKALLEEAQKDIRNQSLILEQSRCSTSQFVEFRVENNLKNVKQQISDSVGKFSDLGLLIDPKKEASMSKVVQQVGFVGLQLYREGKLYSRRLVEDCFTNFVNKHLAIGDEYPPEAYGLVQSSYFHGLNPYEELIHAISTREAMIRSSRGLSEPGTLFKNLMAILRDVVICYDGTVRNICSNSIIQLKYGEDDETDSSSVVPPGEPVGVLAATAISNPAYKAVLDSSQSNNASWESMKVVML

SEQ ID NO: 738 - protein, 1850 aa, Zea mays
MDARFPYSPAEVAKVEFVQFGILSPDEIRQMSVIQIEHAETMERGKPKPGGLSDPRLGTIDRKIKCETCMAGMAECPGHFGHLELAKPMFHIGFIKTVLSIMRCVCFNCSKILADEDETKFKQALKIRNPKNRLKRIYDACKSKKVCAGGDDLDVQEQDTDEPIKKRGGCGAQQPNITVDGMKMVAEFKAPKKKTDDQDQLPEPVERKQILSAERVLNVLKRISDEDCLLLGLNPKYARPDWMILQVLPVPPPPVRPSVMMDTSSRSEDDLTHQLAMIIRHNENLRRQERNGAPAHIITEFAQLLQFHIATYFDNDLPGQPRATQRSGRPIKSICSRLKAKEGRIRGNLMGKRVDFSARTVITPDPNINIDELGVPWSIALNLTYPETVTPYNIERLKELVEYGPHPPPGKTGAKYIIREDGQRLDLRYVKKSSDQHLELGYKVERHLNDGDFVLFNRQPSLHKMSIMGHRIKIMPYSTFRLNLSVTSPYNADFDGDEMNMHVPQSFETRAEVLELMMVPKCIVSPQSNRPVMGIVQDTLLGCRKITKRDTLIEKDVFMNILMWWQDFDGKIPAPTILKPRPIWTGKQVFNLIIPKQINLIRFSAWHSEEEKGFITPGDTMVRIEKGELLSGTLCKKSLGTGSGSLIHVIWEEVGPDAARKFLGHTQWLVNYWLLQNGFSIGIGDTIADASTMETINDTISKAKNAVKELIKKAHEKQLEAEPGRTMMESFENRVNQVLNKARDDAGSSAQNSLSESNNLKAMVTAGSKGSFINISQMTACVGQQNVEGKRIPFGFIDRTLPHFTKDDYGPESRGFVENSYLRGLTPQEFFFHAMGGREGLIDTAVKTSETGYIQRRLVKAMEDIMVKYDGTVRNSLGDVIQFLYGEDGMDAVWIESQKLDSLKMKKPEFDNVFRYELDDENWRPNYMLPEHVDDLKTIREFRNVFEAEVQKLEADRYQLGSEITTTGDNSWPMPVNLKRLIWNAQKTFKIDFRRPSDMHPMEIVEAIDKLQERLKVVPGDDAMSIEAQKNATLFFNILLRSTFASKRVLKEYRLTKEAFEWVIGEIESRFLQSLVAPGEMIGCVAAQSIGEPATQMTLNTFHYAGVSAKNVTLGVPRLREIINVAKKIKTPSLSVYLKPQVNQKKELAKNVQCALEYTTLRSVTHATEIWYDPDPLGTIIEEDTEFVQSYYEMPDEDIDPDKISPWLLRIELNREMMVDKKLSMADIAEKINREFDDDLSCIFNDDNADKLILRIRITNDEAPKGEIQDESAEDDVFLKKIEGNMLTEMALRGIPDINKVFIKEGKVNTFYQDDGFKAANEWMLDTEGVNLLAVMCHEDVDATRTTSNHLIEVIEVLGIEAVRRSLLDELRVVISFDGSYVNYRHLAILCDTMTYRGHLMAITRHGINRNDTGPLMRCSFEETVDILLDAAVYAESDHLRGVTENIMLGQLAPIGTGGCALYLNDQMLQQAIELQLPSYVEGLDFGMTPARSPITGTPYHEGMMSPSYLLSPNIRASPINTDASFSPYVGHMAFSPFPSPGGYSPSSGGYSPSSPVFTPEKGYSPLSPSYSPASPSYSPTSPSYTPGSPTYSPTSPNYSPTSPTYSPTSPSYSPTSPSYSPTSPSYSPTSPSYSPTSPSYSPTSPSYSPTSPVYSPTSPAYSPTSPAYSPTSPSYSPTSPSYSPTSPSYSPTSPSYSPTSPSYSPTSPSYSPTSPAYSPTSPGYSPTSPSYSPTSPSYSPTSPSYNPSSAKYSPSHAYSPSSPRMSPYSQTSPSYSPTSPTYSPTSPSYSQPSPSYSPTSPFNTSGGPSPDYSPTSPNYSPSGSYSPTAPGYSPSSTGQGNDKDDKSAR

SEQ ID NO: 739 - protein, 1229 aa, Zea mays
MEEPQKDSGQPSKSSDSELEAMVLDDNGAGKSHSMEENRDSPIDVDGGQSSMDVDIKGKSSLSDDVNGKSSSEPYSNAPIDMSVESLEKFCKEASRSFFDEVGLISHQINSYNEFVSHGLQELFDSLGEVIVEPGYDPSKKGSGGWKHAIIKFGRVKLEKPVFWTGKDEGSVDFKPWHARLQNMTYASRLIVEVTIQVYSLEKSDKSKTGNDGFVQKRNFMNETHWIFIGLLPVMVKSNLCLLHSLNESECLFDAGGYFLVKGMEKVFIAQEQRCLRRLWISDRPCWTISFMSEIKRRRIYIKLVESTRSEDFSESKIITISFLYATMPVWLLFFALGISSDKEVFDMIDMQDCDASVINTISATIKESDKLCEDFRKSDKARQYVDELVKSSRFPPAESFDDYIARFLFPDISGNRNKALFLGYMVKCLLMAFTGKRKCDNKDDFRNKRLDLPGELLGRELRAQLRLAEKRMVKAIQRDLNSDRELQDLERYIDASIVTNGLNRAFSTGSWCHPYKRAERCSGIVATLRRTNPLQMMSDLRKTRQRVAYAGKAGDARYPNPSYWGKLCFMSTPDGENCGLVKNLAVTAIVSSRVMQPLIESFISCGMSKLNDIPTEHIQRMDKIFLNGNWVGSCENSASFVFRLRCMRRSSLIDPQVEIKRDKHHNEVRVFTDAGRILRPLLVVENLNKIRKPKGRSFSFHELMQQEIIEFIGVEEEEDIQCAWGIRHLFESEGAISSYTHCELDPSFLLGLSCGIIPFANHNFARRVLYQSEKHSQQAIGYSTTNPHIRVDTLSHQLYYPQRPLFKTVIADCLGRSDYASFGRKNDFARPEYFNGQNAIVAVNVHQGFNQEDSLVMNRASLERGMFRTEHLRSYKADVENKDGTKRLKLKEKIDFGKTESKRGRVDNLDDDGLPYVGASLQTNDIVIGKVSESGEDHSIKLKHTEKGMVQKVLLSANDEGKNFAVVTLRQVRTPCLGDKFSSMHGQKGVVGFLESQENFPFTHEGIVPDIVINPHAFPTRQTPGQLLEAALGKGIACKGTMRYATPFTTASVDVIAEQLHRAGYSRWGSENVLNGRTGERVQSLVFMGPTFYQRLIHMSEDKVKFRNTGPVHPLTRQPVADRKRFGGVKFGEMERDCLLAHGSAANLHERLFLLSDFSQMHICQTCERVANVVMRSVPGGKKIRGPYCGFCKSSENIVRINVPYGAKLLYQELFSMGICLKFETQVC

SEQ ID NO: 740 - protein, 1063 aa, Zea mays
MEEPQKDSGQPSKSSDSELEAMVLDDNGAGKSHSMEENRDSPIDVDGGQSSMDVDIKGKSSLSDDVNGKSSSEPYSNAPIDMSVESLEKFCKEASRSFFDEVGLISHQINSYNEFVSHGLQELFDSLGEVIVEPGYDPSKKGSGGWKHAIIKFGRVKLEKPVFWTGKDEGSVDFKPWHARLQNMTYASRLIVEVTIQVYSLEKSDKSKTGNDGFVQKRNFMNETHWIFIGLLPVMVKSNLCLLHSLNESECLFDAGGYFLVKGMEKVFIAQEQRCLRRLWISDRPCWTISFMSEIKRRRIYIKLVESTRSEDFSESKIITISFLYATMPVWLLFFALGISSDKEVFDMIDMQDCDASVINTISATIKESDKLCEDFRKSDKARQYVDELVKSSRFPPAESFDDYIARFLFPDISGNRNKALFLGYMVKCLLMAFTGKRKCDNKDDFRNKRLDLPGELLGRELRAQLRLAEKRMVKAIQRDLNSDRELQDLERYIDASIVTNGLNRAFSTGSWCHPYKRAERCSGIVATLRRTNPLQMMSDLRKTRQRVAYAGKAGDARYPNPSYWGKLCFMSTPDGENCGLVKNLAVTAIVSSRVMQPLIESFISCGMSKLNDIPTEHIQRMDKIFLNGNWVGSCENSASFVFRLRCMRRSSLIDPQVEIKRDKHHNEVRVFTDAGRILRPLLVVENLNKIRKPKGRSFSFHELMQQEIIEFIGVEEEEDIQCAWGIRHLFESEGAISSYTHCELDPSFLLGLSCGIIPFANHNFARRVLYQSEKHSQQAIGYSTTNPHIRVDTLSHQLYYPQRPLFKTVIADCLGRSDYASFGRKNDFARPEYFNGQNAIVAVNVHQGFNQEDSLVMNRASLERGMFRTEHLRSYKADVENKDGTKRLKLKEKIDFGKTESKRGRVDNLDDDGLPYVGASLQTNDIVIGKVSESGEDHSIKLKHTEKGMVQKVLLSANDEGKNFAVVTLRQVRTPCLGDKFSSMHGQKGVVGFLESQENFPFTHEGIVPDIVINPHAFPTRQTPGQLLEAALGKGIACKGTMRYATPFTTASVDVIAEQLHR

SEQ ID NO: 741 - protein, 1259 aa, Zea mays
MGKPQTDGDQSPVNSDTDVMDCLNFDGHGDVEDPHKEVAKGEQQPSGEVDEQQSVMDVDLTCITSVGDEGNEKQNAMDVDLKEILSEEDGGEGKASSDLPSQVPVDFNVASLEKFCKEAARSFFSETGLVSHQINSYDHFVSHGLQELFDSLGEITVEPDYDPSNKHGAWKHATVKFGRVKLDEPVFMLENSDLEEQDLKFKPRHARLQKMTYASRMNVEMTVQVYIFDTSDKAKTGKDTHVHKREIMTETKQINIGLLPVMVKSNLCWLHKSQKGDCPFDFGGYFLIKGTEKVFIAEEQRFLSRIWVTDHPSWDASYLSQIRREKINIKLVPSKSNESCKVINICFMGTIMPIWVAFFALGVSSDKEAFDMIDILDCDADIVNIISLTIKESHEEFEGFRTPGRARQYVDELIRKSKFPPKESFDEYVCRYMFPGVNGFRSKALFLGYMVKCLLMAYSGNRKCDNKDDLRNKRLDLSCQLLRRELWTHIKRAERRMVKLMQRDLSNDGNLQDLRRYVDASIITNGLNRAFSTGSWRHPYKKERCSGVVATLRRTNPLQMMSDVRKTRQWFAYAGTAGDARYPNPSYWGKLCFLSTPDAEKCGFVKNLAVTAVVSSVVRKPLIDTFVSCGMKKLDDISLQDISGKDRIFLNGSLLGVCADPHELTLRLRSLRRSKLIDPQVEIKRDKHHKEVRVFSDPGRIMRPLLVVENLRRITRPKDGLYSFQELIDQNIVELIGVEEEEDIQCAYGIRHLFSSREKEDWSSSGYTHCELDPSFLLGLSCSLIPFGNHDNARRVQMQAEKISQQAIGYSPTNSQYRLDTLSHQMFYPQRPLFRTVVSYGLGEAKTDCSSGRKDDFNTPEYFNGQNAIVSVNVHQGFNQEDSLVMNRASLERGMFRTLHFKSYKAQVENKEITRRLKHRENINFGKVQSKRGKVDSLDSDGLPYVGASLQSGDIVIGKVTESGEDHSAKLMHTEKGMVDKVVLSANDDGVNFATVTLRQSRSPCVGDKFASMHGQKGVVGLLDSQENFPFTSQGIVPDMVINPHGFPTRQTPGQLLEAALGKGIALGGKVRYATPFTTPTVEVIAEQLHKAGFCRWGEESVLNGQTGERMKSLVFMGPTFYQRLVHMAEDKVKFRNTGPVHPLTRQPVEDKKRFGGVKFGEMERDCMLAHGAAANLHERLFTLSDFSRMHICQACERVANVIVRAAEGGGGKKVRGPYCLFCRSAERVVRVDVPYGSKLLYQELFSMGICLKFETEVR

SEQ ID NO: 742 - protein, 267 aa, Zea mays
MEELQKDSALPSNSSDSEPEAMELDDNGAGKSHSIEGNRDSPIDTDEGQPSMDVDIKGKSSLNDDVNGKSSSEPFSNPPINMSVESLEKFCKEASRSFFDEVGLISHQINSYNEFVSHGLQELFDSLGEVIVEPGYDPSKKGSGSWKHAIIKFGRVKLEKPVFWTGKDEVSVDFKPWHARLQNMTYASRLRVEVTIQVYSLEKSDKSKTGNDGFVQKRNFMNETHWIFIGLLPVMVKSNLCLLHSLKESECLFDAGGYFLVKGMEKV

SEQ ID NO: 743 - protein, 1127 aa, Zea mays
MSTAAPAPGSTATVRVSNIPASAIAAELLAFFDSAVTIAGATFACEIVAAHRGWLSRGHGFVQFDSSAAATHAIDLASSGRLPPFLGSCLSVSPARADLLPRAPDLSLRAASASLILGNRVAERELEVAYSCDGVRAEVIPRMRRVDLYLKHDSQSYKLEVLFEDINECFGCHLDGTGAILLQLTYAPRIHIAISGSTVKSRFTDDRFHACKEDAKFAWVRALDFTPNSSFGECSTLVLKLSKGASVSYILESLPFSGELGELAIASMDVFGSSSNVVPLVDCPNGFSVPYEVLFRLNSLVHMGKLVARHVNADLFKVLEDLSIDTLRRIFEKMSKLKSTCYEPLQFIRHEAHSMNMRKKALSNKRESGKLMRCYRIHITPSKIYCLGPEEEVSNYVVKYHSEYASDFARVTFVDEDWSKLSPNALSARTEQGFFSKPLKTGLYHRILSILKEGFCIGPKKYEFLAFSASQLRGNSVWMFASNSSLTAENIRRWMGHFEDIRSVSKCAARMGQLFSSSRQTFEVSSYDVEVIPDIEVTTDGTKYIFSDGIGKISTRFARQVAKLIGLDPAHPPSAFQIRYGGYKGVITIDPTSFFNLSLRPSMKKFESKSTMLNITNWSKSQPCYVNREIISLLSTLGIKDEVFESMQQDDMHESDGMLTNKEAALSVLGKIGGGDTKTAADMLLQGYEPSSEPYLLMILKAHRANRLTDIRTRCKIHVQKGRVLIGCLDETCKLEYGQVYIRITKNHKEQKYSEQPFFCNDDGKTAVIVGKVAITKNPCLHPGDVRVLEAVYDPGLDARGLIDCVVFPQRGERPHPNECSGGDLDGDLFFITWDDKLIPEKVDAPMDYTATRPRIMDHAVTLEEIQKHFVSYMINDTLGAISTAHLIHADRDPLKARSPECVQLAALHSMAVDFAKTGAPAEMPLALRPREFPDFMERWERPMYVSNGVLGKLYRAALRHEEDAEALLPAGPPSCVYDPDLEVAGFDEFLDAAEERYEAYAERLGALMTYYSAEREDEILTGNIRNKLVYLRRDNKRYFEMKDRIIAAVDALHAEVRGWLRACKEDDASRVASAWYHVTYHPDRRGEKRFWSFPWIICDTLLAIKAARRCRKRVEDAAVPMDCDGS

SEQ ID NO: 744 - protein, 937 aa, Zea mays
MGSLRGAAASSAAPRAGDLVTTQVSLGGFDATVKALDLADFLELNAGSVWRCRLKTSWTPPDAYPDFLLPTVTSAAAPPPQYDRVPPHAFVHFARPEGARAAADAAGRSELILSGKPLRAASAQDSSLRASRRRSVSPFRFPGSRLEVGDLPASDAFIAAWRGPASGLEFSVDPFDGSCHFIFARDTAFKVREFRESVVMRCDVKLQFPVRDVAEVRVFRLDCSLLIRLSAAPLVCYRTADDDIHVSVPFDLLDDDDPWIRTTDITPSGAIGRCGAYRITFSPRFWPKMERALTYMRDRRVAILDCVGGWGARRGLTVRDEPEFGERMQDLFFCVQHAEGLKFPVLFLVNALVHKGVISQHHLTPEFFGLLQRKEDDVNVAALREFWGDKFPVFDACGRLKNLQDRVARYLKHLRNKIGDVNSEVRRLVITPTKAYCMPPEVERSNRVIRHYSEVSDRFLRVTFMDERMQMLNSNVLNFSAAQIVKDLMSNSFLHKTTVYKRVKTFLTEGFHMCGRKYSFLAFSSNQLRDRSAWFFAEDRTTTVETIRKWMGRFTSKNVAKHAARMGQCFSSTYATVVLQPHEVNECLDEVEHNGYIFSDGIGKITCDLALEVAQKLQLTDNPPSAYQIRYAGFKGVISVWEGKNDGIRLSLRPSMHKFESNHTVLEVVSWTKFQPGFLNRQIITLLSSLNVPDAIFAQMQEAMLSNLNNILSDSDVAFDIVTASCAEQGTTAALMLSAGISPGTEPHLKAMLLAIRSSQLLGLLEKTRIFVPKGRWLMGCLDELGILEQGQCFIRASSPSLNNCLVKYGSRLSAANTNAETILGTIVMAKNPCLHPGDVRILEAVDVPELHHLVDCLVFPKKGERPHANEASGSDLDGDLYFVTWDENLIPPGKKSWNPMDYSPAEAKQLPRAVSQHFWTMSLYGYIVFYSLQSGF

SEQ ID NO: 745 - protein, 1901 aa, Zea mays
MEVSHRGRRPSPEPRRNPSIAGDLGIQSMNRTRCDEAFDETNAAHPHHERRRTAGRRPPGHNLAEEWPTGPATRAILTGFDAGLSARGLADELERLAGTVWRCRIKTSVTPPESYPDFQLSVHAAAAAAVFHQDEPPRDGRVAPHAFVHFEHRNAADRAGDFFTTRILAQSRHMLHGHAARRRDGVTDAAKPMLFPNSCIEIGDVVAPDTFLVAWRGTDDSASALDFVVDPSGGSCRLLFARYTAFTCPDRRRPAALLCCDVKLEFALAHVAEALAFQADDSLVLRLSAAPLVYYRTSGDDVHGRVPFQLVDADDDPWIRTTDVTRSGAIGRCLAYRVSFAVQFWPTMRVALECMQRQGVPVHVRDRRCRGFTVLEEAGLVQPMRDAFFSPRHDDDAGAGLRFPVLYLVNVLMHNGVVNPHQMTPEFFGLLMRTREDVNVAALTELFGAKLGVCDNPCWREYCMPVERSNRVIRHYHELSDRFLRVTFTDEGMLPLNPNALTLRAVPSTSTPSTSRQMTSVYRRVQTALTEGLIMCGRRYSFLAFSASQLKQKSAWFFAEDGATTVAGIKEWMGQFPIRNPAKHAARMGLCFTSSYATVTMQPGEVDEDLEDVTRNGYNFSDGIGVITEDLALEVAEMLPLADRFAPSAYQIRREVFEETRVAMARSRTRSPESTRRLAHRLRAIKPSKSNQQHPHHERRRTAGRRPPGHNFAEEWPTGPATRAILTGFDAGLSARGLADELERLAGTVWRCRIKTSVTPPESYPDFQLSVHAAAAAAVFHQDEPPRDGRVAPHAFVHFEHRNAADRAGDFFTTRILAQSRHLLHGHAARRRDGVTDAAKPMLFPDSRIEIGDVVAPDTFLVAWRGTDDSASALDFVVDPSGGSCRLLFARYTAFTCPDRRRPAALLCCDVKLEFALAHVAEALAFQADDSLVLRLSAAPLVYYRTSGDDVHGRVPFQLVDADDDPWIRTTDVTRSGAIGRCLAYRVSFAVQFWPTMRVALECMQRQGVPVHVRDRRCQGFTVLEEAGLVQPMRDAFFSPRHDDDAGAGLRFPELYLVNVLMHNGVVNPHQMTPEFFGLLMRTREDVNVAALTELFGAKLGVCDNPCWRLKNAQDKAAKNLDLVCRSSSSRRKASDCDAEVRRLIVTPTREYCMPPQVERSNRVIRHYHELSDRFLRVTFTDEGMLPLNPNALTLRAVPSTSTPSTSRQMTSVYRRVQTALTEGLIMCGRRYSFLAFSASQLKQKSAWFFAEDGATTVAGIKEWMGQFPIRNPAKHAARMGLCFTSSYATVTMQPGEVDEDLEDVTRNGYNFSDGIGVITEDLALEVAEMLPLADRFAPSAYQIRYAGFKGVVAVSPPGPGQEDRGTRRMSLRPSMRKFESTHNVLEVVSWTKFQPAFLNRQIITLLTTLGVPDDSFWQLQEAMLGKLRRVLSDSDVAYEVVTNSCPEQGSTAGLMLGAGFAPATEPHLRAMLLAICTSQMQGLLNKTWIFVPKGRWLMGCLDEFGILEQGQCFLRVSTPSLGSRCVNRSPIFPSEYKGDANAQVITGTVVMAKNPCLHPGDVRILEAVDVPDLYHLVDCFVFPKKGERPHADEASGSDLDGDVYFVTWDESLVPPGRKSCTPMDYSPAKTKQLPHDVHQQDTIDFYLESMVYDNLGRICNAHAAHADRSDDGAMDPKCIELARLASIAVDSAKTGEIVRMPPALSPKEYPDFMGKEDAISYRSEKILGRLYRSVLGENDGDFLSRGACISDEIRYDADLEVPGASDFLQDAWRCRCLYEARLNALLDQYNVRSEAELVTGEIWSLAGCSKKYQHQLKERINYAYSKVHQEFRIIFESIGASTDNKNLAYEMKASAWYQVTYHPEIIRSREPGDEDAPTRLSFAWIAVDYLAQIKMKRHVD

SEQ ID NO: 746 - protein, 1241 aa, Zea mays
MARSRTRSPESTRRLAHRLRAIKPSKSNQQHPHHERRRTAGLRPPGHNFAEEWPTGPATRAILTGFDAGLSARGLADELERVAGTVWRCRIKTSVTPPESYPDFQLSVHTAAAAVFHQDQDEPPRDGRVAPHAFVHFEHRNAADRAGDFFTTRILAQSRHLVHGHAARRRDGVTDAAKPMLFPDSRIEIGDVVAPDTFLVAWRGTDDSASALDFVVDPSGGSCRLLFARYTAFTCPDRRRPAALLCCDVKLEFALAHVTEALAFQADDSLVLRLSAAPLVYYRTSGDDVHGRVPFQLVDADDDPWIRTTDVTQSGAIGRCLAYRVSFAVQFWPTMRVALECMQRQGVPVHVRDRRCRGFTVLEEAGLVQPMRDAFFSPRHEHDDDAGLRFPELYLVNVLMHNGVVNPHQMTPEFFGLLMRTREDVNVAALTELFGAKLGVCDNPCWRLKNAQDRAAKNLDLVCRSSSSSRRRKASDCDAEVRRLIVTPTREYCIPPQVERSNRVIRHYHELSDRFLRVTFTDEGMLPLNPNALTLRAVPSTSTPSTSRQMTSVYRRVQTALTEGLIMCGRRYSFLAFSASQLKQKSAWFFAEDGATTVAGIKEWMGQFPIRNPAKHAARMGLCFTSSYATVTMQPGEVDEDLEDVTRNGYNFSDGIGVITEDLALEVAEMLPLADRFAPSAYQIRYAGFKGVVAVWPPGPGQEDRGTRRMSLRPSMRKFESTHTVLEVVSWTKFQPAFLNRQIITLLTTLGVPDDAFWQLQEAMLGKLRRVLSDSDVAYEVVINSCPEQGSTAGLMLGAGFAPATEPHLRAMLLAICTSQMQGLLNKTWIFVPKGRWLMGCLDEFGILEQGQCFLRVSTPSVGSRCVNRSPIFPSEYKGDADAQVITGTVVMAKNPCLHPGDVRILEAVDVPDLYHLVDCFVFPKKGERPHADEASGSDLDGDVYFVTWDESLVPPGRKSCTPMDYSPAKTKQLPRDVHQQDTIDFYLESMVYDNLGRICNAHAAHADRSDDGAMDPKCIELARLASIAVDSAKTGEIVRMPPALSPKEYPDFMGKEDAISYRSEKILGRLYRSVLGENDGDFLSRDACISDEIRYDADLEVLGASDFLQDAWRCRCLYEARLNALLDQYDVCSEAELVTGEIWSLAGCSKKYHHQLKERINYAYSNLHQEFRSIFESIDASTDNKNLAYEMKASAWYQVTYHPEIIRSREPGDEDAPTRLSFAWIAVDYLAQIKMKRHVD

SEQ ID NO: 747 - protein, 594 aa, Zea mays
MSGSGDRRGGGPPGSHSGWETMGKKSKKPGQAGGRQWAPWSSTNVTPNTARPAWGGSGSSHPSGTSWAQAPDHGAATRGNPRPPSQTSRPVLAPPLANGWQWQSRPRPSGSEVKKDDAPPSGSVPEVENVDGNNTSDDDDDDDDDLSDDISDDYDSDASEKSFETRKTNKWFKEFFEVLNTLSLEQINEQTRQWHCPACKNGPGAIDWYKGLQPLVSHARTKGSTRVKLHRELAALLEEELSRRGTSVLPAGEQFGKWKGLQESTDREIVWPPMVIVMNTFLEKDEDDKWKGMGNQELLDYFGEYEASKARHAYGPSGHRGMSVLIFESSAVGYMEAERLHKHFVNQGTDRNSWHLRKVRFVPGGKRQLYGFLANKEDMEAFNKHCHGKSRLKYEMRSYNEMVVIQMKQMSEDNQQLNYLKNKMVKTEQRSKAVEESLGVVTQKLRETIEENIFVRSKAKEKHMEYEEEMKSQEEIFHGLIEDIHKATEDKEKQFEKLLQEERSKARRFDVDSGTMKDRQLRKEYVQKFIDCQVKDVAEFEVERDELIKVHEDKKLKLKKEYMDLELELEKEFDAALTGLMEKHKPDTFEASSS

SEQ ID NO: 748 - protein, 682 aa, Zea mays
MDVVESSPSSSPISSPAGSSESIDLNFLPFLKREPKSEPASPELGPLPLPAPPTQTPQQQHAAAPAPEATAPLSPATPDLSSAPVMAPLQSLPPNLDEDALLREYYRLAGLYLSSARSGAIIPALAPEAAAPAVVQSGSGSVVKKRRPRSSDLVRVSSLGVQDQIYFRDLVRRARITFECLRGLLLRDDERAESLGLAAVAGFGVARDRRRVRADLRAAALMGDHDLWLNRDRRIVGPMPGISVGDAFFFRMELCVLGLHGQVQAGIDYVSAGRSASGEPIATSIIVSGGYEDDDDHGDVLVYTGHGGRDPNLHKHCVDQKLEGGNLALERSMAYGIEIRVIRAVKSRRSPVGKVYFYDGLYKVVDYWLDRGKSGFGVYKYRLLRIEGQEPMGSVNYRVAEQLKVDVFAIRPTGYLSFDISMGRDTLSVALFNDVDDDQDPLLFEYLARPIFPTSAVQGKFAEGGGGGCDCAEICSIGCNCAGRNGGEFAYDRTGTLLRGKPLVYECGPYCRCPPSCPNRVSQKGLQHRLEVFRSRETGWGVRSLDLIKAGTFICEFSGIILTHQQSEVVAANGDCLVRPSRFPPRWLDWGDISDVYPDYVAPDHPSIPELKFAIDVSRARNVACYFSHSCSPNVFVQFVLFDHYNVSYPHLMIFAMENIPPLRELSIDYGMVDEWIGQLTM

SEQ ID NO: 749 - protein, 711 aa, Zea mays
MPREGLGNFGAEEEARDGGQEGLVTEMDVEESSPSSSPMSSPAGSSDSIDLNFLPFLKREPKSEPSSPELGPLPLPVSLTQTPPQQHAAAAAPATEASVPPPPATPDLSSASMMTPLQSLPPNPDEDSLLREYYRLARLYLSSAGSGAIVPTPAPEAAAPAVVQSGAGSVVKKRRPRSSELVRVSSLGVQDQIYFRDLVRRARITFECLRGLLLRDDERAESLGLAGAAGFGVARDRRRARADMRAAALMADHDLWLNRDRRIVGPMPGISVGDAFFFRMELCVLGLHGQVQAGIDYVSAGRSASGEPIATSIIVSGGYEDDDDHGDVLVYTGHGGRDPNLHKHCVDQKLEGGNLALERSMAYGIEIRVIRAVKSRRSPIGKVYFYDGLYKVVDYWLDRGKSGFGVYKYKMLRIEGQEPMGTVNYRAAEQLKVDVFAVRPTGYFSFDISMGRETLPVALYNDVDDDQDPLLFEYLTRPIFPTSAVQGKFAEGGGGGGCDCAEICSIGCNCAGRNGGEFAYNKTGTLLRGKPLVYECGPYCRCPPSCPNRVSQKGLQHRLEVFRSRETGWGVRSLDLIKAGTFICEFSGIVLTHQQSEVMAANGDCLVRPNRFPPRWLDWGDISDVYPDYVAPDHPVIPELNFAIDVSRARNVACYFSHSCSPNVFIQFVLFDHYNVSYPHLMIFAMENIPPLRELSIDYGMVDEWTGQLTM

SEQ ID NO: 750 - protein, 933 aa, Zea mays
MFQVQAAPKIYKLLPGRPGLMFEDPFFNWFRDDTDEQWTRTIDFTPSASIGQSSILCLEVPQQCELPRIGDYFVYYKEQNLDFECRNGYSYSCGSNLVPIVKSPDYIEVPYEILFKINHLVQNGTLSGPTVDHSFFRHVSPKFEPIDHIKRALLKMTYLKSTCLNPTDWLSVQYSRIRKSRHASQKLSNISLDDGLVYVHRVQVTPAKVYFYGPEINVSNRVVRHFSADIDNFLRISFVDEDCEKLRSADLSPRSTSGNDARRTALYNRVLSVLSNGINIGDKHFEFLAFSSSQLRDNSAWMFASRQGLTASDIRKWMGDFRDIRNVAKYAARLGQSFSSSTETLKVHKSEVERIPDITNGTKYIFSDGVGKISANFAVEVAMKCKLKRFAPSVFQIRYGGYKGVVAVDTRSNHKLSLRKSMSKFQSENITLDVLAYSKYQPCFLNRQLITLLSTLGVSDNVFELKQKEALRQLNRMVTEPQAAREAVELMPMGEVTNVVKELLSCGYQPDHEPYLSMLLQTFRASKLLELKTKSRIFITQGRAMMGCLDETCTLKYGQVFVQASYSADDHRKVVVTGKVVVAKNPCLHPGDIRVLQAVDVPALHHLFDCVVFPQQGPRPHPNECSGSDLDGDIYFVSWDPHLIPSRLVDPMDYTPASAETLDHDVTIEEIQEYFTNYIVNESLGIIANAHVVFADQERMKAESPPCVQLAKLFSIAVDFPKTGVPALIPHELHVKEYPDFMEKLDKVTYESKGVIGKLYREIKKHTPHIKHFTREVARRSYDTDLIVDGYEDYITEAIEFKEEYDFRLGNLMDHYGIKSEAEIISGCILKMAKNFTKSSDADAIRMAVRSLRKEARSWFNEMSTGEDGQDAMEAKASAWYHVTYHQQYWGSYNEGYDRPHLISFPWCVYDKLVAIKQGRNLLTRMDRNLRFR

SEQ ID NO: 751 - protein, 1307 aa, Zea mays
MKSDSNDVEMHNSENPKPNELEEGELPDSHGEHVDEVIGAAVADGKVTPRVQALIKILLKYQHTEDFRAIIFVERVVTALVLPKVFAELPSLGFIRCASLIGHNNNQEMRSCQMQDTITKFRDGRVTLLVATSVAEEGLDIRQCNVVIRFDLAKTVLAYIQSRGRARKPGSDYILMLERGNMSHEAFLRNARNSEETLRKEAIERTDLSHLDGTSMLSPVDISPDSMYQVESTGAVVSLNSAVGLVHFYCSQLPSDRYSILRPEFIMQKHEKPGGSTEYSCKLQLPCNAPFEKLEGPICSSIRLAQQAVCLAACKKLHEMGAFTDMLLPDRGSGEGEKTEQNDEGDPLPGTARHREFFPEGVAEILHGEWILSGRDGYQSSQFIKLYLYSVNCVNIGTSKDPFVTQLSNFALIFGNELDAEVLSTTMDLFVARTIITKASLVFRGPIEITESQLILLKSFHVRLMSIVLDVDVDPSTTPWDPAKAYLFVPVGAEKCMDLLREIDWTLVNSIVNSDAWNNPLQRARPDVYLGTNERTLGGDRREYGFGKLRHGTAFGQKAHPTYGIRGAIAEFDVVKASGLVPGRGWGHFNDYQNKGKLFMADSCWDAKDLAGMVVTAAHSGKRFYVDSICYNMNAENSFPRKEGYLGPLEYSSFADYYKQKYGVELVYKKQPLIRARGVSYCKNLLSPRFEHSEASNGEFSENLDKTYYVYLPPELCLVHPLPGSLVRGAQRLPSIMRRVESMLLAIQLKDIIGYPVPANKILEALTAASCQETFCYERAELLGDAYLKWVVSRFLFLKYPQKHEGQLTRMRQQMVSNMILYQYALNKNLQSYIQADRFAPSRWAAPGVLPVFDEETRDSEPSIFDEEFTPSSELQKNLYDDYDGDSMQEDGEIEGDSSCYRVLSSKTLADVVEALIGVYYVAGGKIATNHLMKWIGINAELDPQEIPSSKPYNIPESIIKSINFDTLEGALGIKFQNKGLLVEAITHASRPSSGVSCYQRLEFVGDAVLDHLITKHLFFTYTDLPPGRLTDLRAAAVNNENFARVAVKHKLHVHLRHGSSALETQIREFVKDVQEELSKPGFNSFGLGDCKAPKVLGDIFESIAGAIFLDSGCATSVVWKVFQPLLDPMVTPDTLPMHPVRELQERCQQQAEGLEYKASRTGNVATVEVLVDGIQIGVAQNPQKKMAQKLAARNALVVLKEKETAAKKDTEKDGEKKNGSQFTRQTLNDICLRRQWPMPQYRCINEGGPAHAKRFVYAVRVNTSDSGWTDECIGEPMPSVKKAKDSAAVLLLELLNRNYRGKPDGK

SEQ ID NO: 752 - protein, 511 aa, Zea mays
MKCIVFVKRIIVARVVVQILQNLKCLDFWRCEFLVGCHSGLRNMSRDKMSSIIEKFSSGEVNLLVATSVGEEGLDIQTCCLVVRFDLPETVNSFIQSRGRARMSKSKYVFLLERGNHSQEKLLDDYITGEIIMDKEINLRTSNDMFNCLEENIYRVNDTGASISTACSVSLLHRYCDNLPRDIFFVPSPSFFFVDDVDGIVCKLILPPNAAFRQVNGQPCPSKDEAKRDACLKACIKLHELGALTDFLLPGQGSRKIKVSTTNNSESNKDDDESFREELYEMLIPAVLRPSRCKLDSSFKLHFYYIEFIPIPADRRYQMFGLFVINRLPEESEKLDVELHLARARIVKAGIKYLGKIEFNKEEMILAHNFQEMFLKVLLDRSEFTPSYILLGNDGALDMDSTFYLLLPIKQKFYGDNMIDWPAVKRCLSSPAFQDPMGLSLHDSYLPNESLKLLGGTYNKADVIGSLVYTPHTDLFFFVDAILDGTNAKSELNGATYAEHFKQRHGVRTFF

SEQ ID NO: 753 - protein, 966 aa, Zea mays
MLEVVLDMTPPPPPPQARLHQGSSAKGGHAERRKQPLQSSVTQPKAEPAAAAAVLPVPEGGKRCRGGGRRRGRAKAPGEPRAALLAPAQAQTQAPPPRTVIGPPVPSKGLSFCRRPGFGTVGARCVVKANHFLAELPDKDLTQYDVKITPEVSSRTVNRAIMAELVRLYRASDLGMRLPAYDGRKNLYTAGTLPFDAREFVVRLADEDDGSGVPPREREYRVAIKFAARADLHHLRQFIAGRQADAPQEALQVLDIVLRELANQRYVSIGRSFYSPDIRKPQRLGDGLQSWRGFYQSIRPTQMGLSLNIDMSSTAFIEPLPVIEFVAQILGKDVISRPLSDANRIKIKKALRGVKVEVTHRGNVRRKYRISGLTTQPTHELIFPIDEQMNMKSVVEYFKEMYGFTIQHPHLPCLQVGNQKKANYLPMEACKIIEGQRYTKRLNEKQITSLLKVTCQRPREQEMDILQTVHQNDYEQDPYAKEFGINISEKLTSVEARVLPAPWLKYHDTGKEKECLPQVGQWNMVNKKVINGCKVSHWACINFSRSVPETTARGFCQELAQMCQISGMEFNSEPVMPIYSARPDQVVKALKNVYNIALNKLKGKDLELLLAILPDNNGQLYGDIKRICETDLGLISQCCLTKHVFKISKQYLANVSLKINVKMGGRNTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFANNHKDRSSMDKSGNILPGTVVDSKICHPTEFDFYLCSHAGIQGTSRPAHYHVLWDENNFTADEMQTLTNNLCYTYARCTRSVSVVPPAYYAHLAAFRARFYMEPEMLDNQTSKTSNGTSGVSVKPLPAVKEKVKRMMFYC

SEQ ID NO: 754 - protein, 984 aa, Zea mays
MAPPPPPPPPPPHARHHQGAAKGGHAERRKQPLQSSVTQPKAEPAAAAAAAVLPEGGKRCGGGGGRRRGGRGRAKAPPGEPRVALALAPPPRTVIGPPVPSKGLSFCRRPGFGTVGARCVVKANHFLAELPDKDLIQYDVKITPEVSSRTVNRAIMAELVRLYRSSDLGMRLPAYDGRKNLYTAGTLPFDAREFVVRLTDEDDGTGVPPREREYRVAIKFAARADLHHLRQFIAGRQADAPQEALQVLDIVLRELANQRYVSIGRSFYSPDIRKPQRLGDGLQSWCGFYQSIRPTQMGLSLNIGELCGLGNISCPHACDSFLFCPVAAAYMAMLTADMSSTAFIEPLPVIEFVAQILGKDVISRPLADANRIKIKKALRGVKVEVTHRGNVRRKYRISGLTTQPTHELIFPIDEQMNMKSVVEYFKEMYGFTIQHPHLPCLQVGNQKKANYLPMEACKIVEGQRYTKRLNEKQITSLLKIILYFQTVHQNGYEQDPYAKEFGINISEKLTYVEARVLPAPWLKYHDTGKEKECLPQVGQWNMVNKKVINGCKVSHWACINFSRSVPEATARGFCQELAQMCQISGMEFNSEPVMPIYSARPDQVVKALKSVYNIALNKLKGKELELLLAILPDNNGPLYGDIKRICETDLGLISQCCLTKHVFKISKQYLANVSLKINVKMGGRNTVLLDAISWSIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFTNNHKDRSSMDKSGNILPGTVVDSKICHPTEFDFYLCSHAGIQGTSRPAHYHVLWDENNFTADEMQTLTNNLCYTYARCTRSVSVVPPAYYAHLAAFRARFYMEPEMSENQTSKSSNGTNGGLVKPLPAVKEKVKRVMFYC

SEQ ID NO: 755 - protein, 1013 aa, Zea mays
MASRGRGGGGGKGPSGGRGGEGRGRGIRGGGGYHHGDDGGGERGGRGDPGRGRGVGGRGRGPGGRGVDDHQQQPPPLGNTEGGGQGRGGMAVAVPPARPAAPCPLAPDAAAPAFPAAAASSSAQAPRAPTEAAGAALADGMGKLAVADDRPAAPPVPAGKPVAQGPAHQPQEAPPLSRKRIVPPPRPGLGTSGRKLAVRANHFFVEVSVNDIFHYDVLINPEPKARKTNRMLLSELVKIHGATSLAHKTPAYDGSKSLYTAGELPFKSMEFVVKLGKAGREVDYKVTIRYAARPNVYQLKQLINSQLRNTPFDAIQALDVVLRESPSLNYVTLSRSFFSKKFGDDDIGGGLECWRGYYQSLRPTQMGLSLNIDTCSTSFYQPIDVVKFVADCLQLTNPGQPFLDRDRLKLKRALRGVLVETEHQQGKRSIYRITGITSVPLAQLSFSCNEGPQLTVVEYFAQRYNVQLRYTAWPCLQSGNDSKPIYLPMEVCKIIEGQKYPRKLSDTQVANILKATCKRPQDREENIIKMVRHNNYSADKMAQVFGITVANQMANVQARVLPPPMLKYHESGKEKTVAPSLGQWNMINKKMVNGGTIHSWTCLSFSRIPLRLVDEICHELVQKCNSIGMSFNPRPVTEVQKDSHNNIEAALRDVHRRAPNLQLLIVILPDVTGYYGEIKRMCETDLGIVSQCINPKKNRNKQYFENLALKINVKAGGRNTVLERASVPNGIPFVSDVPTIIFGADVTHPTAGEESSASVGAVVASMDWPQVTTYKALVSAQAHREEIIQNLGGMIRELLISFYKRTGKKPKRIIFYRDGISEGQFNHVLLLEMDAIRKACASLEDGYLPPVTFVVIQKRHHTRLFPGVHGRRDVTDRSGNILPGTVVDTEICHPREFDFYLCSHAGIQGTSRPIHYHVLYDENRFSADGLQILTNSLCYTYARCTRAVSVVPPAYYAHLAAFRGRYYDEQGSSPAPDGTSVVGGDAAAAGDDPPACRRLPQIKENVKEVMFFC

SEQ ID NO: 756 - protein, 941 aa, Zea mays
MAYRGGGGRGGGGRDGDQQRPPHVHGRGAGGPGGGRTFVWPPPPSSTPRPVPPYHHHHHHQVPMGYRAPIVLPHQAAYGVPMAVYRGAPAPAYRVPAPASPRPRVSFSPAPPASPVTIRAPPPSPTTPPAAPTTPAPPRQPAPAPAPEPAPAPPPAPSLAALAKEVEKKLFVSETALAPAAAAAAAAAAQGTAGAGADDAASDVDLAPVSKKGLAHPARPALATVGRNVFVRANHFLVHVADNNLFHYDVAINPESKSRATNREVLNELIKLHGKTSLGGKLPAYDGRKSLYTAGSLPFESEEFVVTLVDPEKKEKESYVTVSRSFFSTTFGHRGDIGEGLECWRGYYQSLRPTQMGLSLNIDISATSFFKPVTIIKFVEEFLNLRDTSRPLFDRDRVKIKKALRGVRIETTHQQDQIRRYKITGITPIPMSQLIFPVDDKGTRKTVVQYFLDKYDYRLKYVSWPCLQAGSDSRPVYLPMEVCKIVEGQRYSKKLNDRQVTNILRATCKRPQEREKSIRDMVLHNKYADDKFAQEFGIEVSSDLVTVPARVLPPPLLKYHDSGREKTCAPSVGQWNMINKKMINGGTIDNWTCLNFSRMRPDEVQRFCMDLTHMCNATGMVVNPRPFIEVRSAAPNHIENALRDVHKRATQILAQQAVGNQLQLLIVILPEVSGSYGKIKRVCETDIGIVSQCCLPKHASRPNKQYLENVALKINVKVVASMDWPEITKYRGLVSAQPHRQEIIEDLFTVSKDPQMGHNVNGGMIRDGVSEGQFSHVLLHEMDAIRKKRHHTRLFPEVHGRRDMTDKSGNILPGTVVDQMICHPTEFDFYLCSHAGIQGTSRPTHYHVLYDENEFTADALQSLTNNLCYTYARCTRAVSVVPPAYYAHLAAFRARYYVEGESSDGGSTPGSSGQTVAREGPVEVRQLPKIKDNVKDVMFYC

SEQ ID NO: 757 - DNA, 3310 bp, Sorghum bicolor
cctcctgttcctctctcacactcccccgcttccttccctgttcgtggaaatctagggttttggaagggtttagatcgcctgctctttgccgcggcggttgttcgtgcgccgcggatttagggagggtttctgcggtgaggggttttgcgccccctggcggtgtgttcttcgtttcttcggggggttttttaccctctttggtgtcaggatcgctgcattccggtctgcgcttagagagggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagggttgcctattagtaaggcaatcattcttccacaataatccttctaactttgttgacctgggtggtggtgtagtgggctgtagagggtttcattctagttttcgtgcaacccagagtggactttcactcaacatcgatgtgtccaccacaatgatagtgaaacctggtcctgtcattgattttctgcttgccaatcagaaagttaatcatccaggcatgattgattgggctaaggccaagcgttcactgaagaacttgaggatcaaaacaagtccagcaaaccaagaacagaagattgttggtctcagcgacagaccttgctgtgagcaattattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgagttatgcagtcttttgcctttacaaaggtacactaaagctttgagcacacttcagaggtcatcacttgttgagaaatctaggcagaaaccacaagaaaggataggtgttttgtctgatgtactgcaaagaagcaactatgatgcagagcccatgctgaaggcctgcgggattacaattgctagaagttttaccgaagttgatggtaggatactgcagccccccaagcttaaagctggcaatggagaagacatttttacacgcaatggtagatggaacttcaacaataagaggctcattaagggtagcagtgttgagaaatgggcagtggtcaacttttctgcacgatgcaatgtcagggatcttgtccgtgatctcatcaagtgtggaggcatgaaggggattatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatgggccttggaagaagaaatgccttgctgaatttgggatcgttacacagtgcgtggcaccaactagagtcaatgatcagtatcttacaaatgtcctactaaagataaatgcaaagctgggtggcatgaattcgttgctccaaattgaaacatccccagcaattcctcaagtatccaaggtcccaactataatcttgggaatggatgtctcccatggttctcctggacattctgatgtaccgtccattgctgctgttgttagttctcgtgaatggcctcttatctcgaaatatagagcttctgtccgcacccaatcacctaagatggaaatgattgactctttgtttaagccacgggaaactgaagatgatggtctgatccgggagtgtctgattgacttctacaccagttctgggaagaagaagcctgaccaagtcatcatcttcagggatggtgttagtgaaagtcagtttaatcaggtgctgaacattgagttgcaacaaatcatcgaggcttgcaagtttttggatgaaaaatggaatccaaagttcacgttgattattgcccagaagaatcaccacactaaattttttattcctggaaagacagaaaatgttccagctggaactgttgtggacaacaaagtttgtcatccaaggaactttgacttctacatgtgttcacatgctggaatgatcgggactacgaggccaactcattatcatatactgcatgatgagataggcttcaatcctgatgatctgcaggagctggtgcattcgctctcttacgtgtaccaaaggagcacaacagccatatcagttgttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctcta

SEQ ID NO: 758 - DNA, 3156 bp, Sorghum bicolor
gtttggaaagccggagggggtgagaagttttctcgccttctcggagacgtcgccatccaccccccgcttccaccactctcggcgggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagggttgcctattagtaaggcaatcattcttccacaataatccttctaactttgttgacctgggtggtggtgtagtgggctgtagagggtttcattctagttttcgtgcaacccagagtggactttcactcaacatcgatgtgtccaccacaatgatagtgaaacctggtcctgtcattgattttctgcttgccaatcagaaagttaatcatccaggcatgattgattgggctaaggccaagcgttcactgaagaacttgaggatcaaaacaagtccagcaaaccaagaacagaagattgttggtctcagcgacagaccttgctgtgagcaattattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgagttatgcagtcttttgcctttacaaaggtacactaaagctttgagcacacttcagaggtcatcacttgttgagaaatctaggcagaaaccacaagaaaggataggtgttttgtctgatgtactgcaaagaagcaactatgatgcagagcccatgctgaaggcctgcgggattacaattgctagaagttttaccgaagttgatggtaggatactgcagccccccaagcttaaagctggcaatggagaagacatttttacacgcaatggtagatggaacttcaacaataagaggctcattaagggtagcagtgttgagaaatgggcagtggtcaacttttctgcacgatgcaatgtcagggatcttgtccgtgatctcatcaagtgtggaggcatgaaggggattatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatgggccttggaagaagaaatgccttgctgaatttgggatcgttacacagtgcgtggcaccaactagagtcaatgatcagtatcttacaaatgtcctactaaagataaatgcaaagctgggtggcatgaattcgttgctccaaattgaaacatccccagcaattcctcaagtatccaaggtcccaactataatcttgggaatggatgtctcccatggttctcctggacattctgatgtaccgtccattgctgctgttgttagttctcgtgaatggcctcttatctcgaaatatagagcttctgtccgcacccaatcacctaagatggaaatgattgactctttgtttaagccacgggaaactgaagatgatggtctgatccgggagtgtctgattgacttctacaccagttctgggaagaagaagcctgaccaagtcatcatcttcagggatggtgttagtgaaagtcagtttaatcaggtgctgaacattgagttgcaacaaatcatcgaggcttgcaagtttttggatgaaaaatggaatccaaagttcacgttgattattgcccagaagaatcaccacactaaattttttattcctggaaagacagaaaatgttccagctggaactgttgtggacaacaaagtttgtcatccaaggaactttgacttctacatgtgttcacatgctggaatgatcgggactacgaggccaactcattatcatatactgcatgatgagataggcttcaatcctgatgatctgcaggagctggtgcattcgctctcttacgtgtaccaaaggagcacaacagccatatcagttgttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctcta

SEQ ID NO: 759 - DNA, 3170 bp, Sorghum bicolor
caggcttcggggactggaggagtgggagaggagaggagcaggacctgggagacctcgcttcgcccgtcctccagtcttccttgcttttcgattttgagggtgctgcttgttttatcttaaaatggggtctcatgatggtgaggatgaagagttgccaccacccccgcccgtgccaccagatgtggttcccattaaagctgaagatgttgtgggggaaccaccagcaaacaagccaataaagccaaagagattactgatggacaggcctggtataggaagaaaagggcagctagcccagctctattcaaatcactttaaagtcgccgtgaagagcacagaagacttcttctttcactattatgtgaacctgaagtatgaggatgatcaacctgttgaaggtaaagggattggcagaaaggtgattgataaactgcagcagacatatcgcgctgagctttccaacaaggattttgcatatgacggagaaaagagcctgtttacagttggtgggcttccacaaaaaaacaatgagttcactgtcgtcttggaggacgcgtctactggaaagactgctgccaatgggagccctggcggtaatgacagtcctggaggtggtgacaggaagagagtgaggaggccataccagacgaaaactttcaaagtggagataaattttgcagcaaaggttcctatgagtgctattggtcaagtcattagaggcgaagaaacggagaactccctggaggcacttcgtgttcttgatatcatactgaggcagcattccgcagaacaaggctgccttttggttaagcaatcgtttttctacaacaacccttcaaactttgttgacttgggtggtggcgtgatgggttgccgtggatttcattcaagtttccgcggcacacagagtggactttccctgaacgttgatgtctcaacaacaatgatcgtgaagcctggccctgttattgattttcttctttctaaccagaatgttaatgatcctagcagaattgattggcaaaaggccaagcgtgctctcaagggcttgaggattagaaccactcctgcaaatgcagaattcaagatttttggtctcagcgagaggatttgtaaagaacaaacgtttccgctgaggcagagaaatggtagcaacggagattgtgataccattgatataactgtctatgactactatgcgaagaaaggaattgatctaaagtactctggtgatttgccttgtataaatacagggagggcaaagcgtccaacatattttccaatcgagctatgctgccttgttccgcttcaaagatacaccaaagctttgtctacgctacaaaggtcatcccttgttgagaagtctagacagaagcctcaagaaaggatgacagttctaaacgatgcactgcaacgcagtaactatgattctgaccccatgttgagggcatgtggcgtttcagttgctccaaaatttacccaagttgaaggaaggatccttcaagccccaaagctgaaagccggcaatggtgatgatatcttctcacgaaatggacggtggaatttcaccaataggaagttttatcaaacctgctctgtggataagtgggcggttgttaatttctctgcacgttgtgatgttcggaatctcatccgtgacctgatgaggaatgcatctgcaaagggaattcaaatggaggaaccttttgatgtgtttgaagagagcccctctatgaggcgtgcacccgtgtcgagaagagtggatgatatgtttgggcagataaaatcaaaacttcctggagctcctaggttcctcatgtgccttctccctgagaggaaaaattgcgaagtctatggtccttggaagagaaagtgcctggccgagtttggtattgtcacacagtgtctagctccaacaagagtcaatgatccgtacctgcttaatttgctgatgaagattaatgcaaagcttggtggtctgaattcgttgctgcaagttgaagcatctccatcaataccccatgtgtcggaagtacccaccatcatcttgggtatggatgtgtctcatggccatccaggacaagataggccttcagttgcagccgtggttagttctcgtcaatggcctcttatctctaaatatagagcatcagtgcacacccaatccgccagactagaaatgatgtcctccttgtttaagccacggggtactgatgatgatggcctcattagggaatcactgattgacttctacactagctctggcaagcgaaaaccagaccacattatcattttcagggatggagtcagcgaaagtcagtttacccaggtcatcaacattgaactggatcagataattgaggcatgtaagtttcttgatgagaagtggtcacccaagttcactgtgattgttgctcaaaagaaccaccacaccaagttttttcagaccggatcaccagacaatgttcttcccggaactgtcgtggacaataaagtttgccatcctaagaactttgacttctacatgtgtgcacatgctgggatgattggaacaacaaggccgacccattatcatgttctgcacgatgagataggtttctctgctgacgaaatgcaggagtttgttcattcgctctcttatgtgtatcaaaggagcacaacagccatctcagtagttgctccaatctgctatgcccaccttgctgcagcccaggtgggcacgttcctgaaattcgaggagatgtcagacacgtcctccagccagggagggcatacctcggcgggcagtgctcccgtgccggagctgcctcgcctgcatgagaaagtgaggagttccatgttcttctgctgatgtgatggtccatcaggatctgggagcgtttgaactgattttggttagcggtagtgatgtgtatgtgtgtgtgtgtatggcatgcaaccagcttggaaccttgaaggctcgcttgttgtgccaacctgacttagctgctggatgcctgaatgtagaggcttttgtaggagaaccagtcagcagtccttgtgtatgcggtgttactgtcagcagctaacatcctagtaaagtttgtctgtggtgtaatgaaccttcacttgataaccttcacttgatgctagctaagctcccctatggatcgatgatgccttgtgctgtt

SEQ ID NO: 760 - DNA, 2300 bp, Sorghum bicolor
gggccgcggctttcacgccgctcggacacccgcaacacctgaccggagagagagggaggcggagaagaaaggggaaaggggaccgaccaggcgaagccggccctcggcaatggagacctctcctcctcctcctcctcctccgccgccgccgccgcagatcgatcatcttctctcgcaattccccatcatccccaaacccgatcccgacggcccaacccctgcgcaaacccccgcccccatcgcagaacggtcggcggcgctgatgctggcgctcaccccggagctctgccaggttctccaccgggagcttgctccttcccccgacgacgatccctacttcgctcgctgccttcgccaatcccagctccacctcgaagccctcgccgccagtctccgccccccctcttcctcctcctcctcctcctccgccgccgccgccgccgcatcccttgcacgagtccttcctccgcctcctccccctcagaaggagttgcggacgcagctgcaacgagaaccaggcgcaggcggcggatccaacccctccagctccaagaagcgcgcgcgcgcctccactgaggtggtgcgcgccacccacctcagccccgcggaccatctccgctaccgcgccctcgtccgccgcgcgcgcctcaccttcgaggcgctccgcagcacctaccagcgccaggagacctccagcggcgtccgcaaccgccatgacctccgcgcctccaggcagatgctctccgctggccactggctccaccgcgaggtccgcatcgtcggcgatatccccggcgtcttcgtcggcgacgccttctactaccgcgccgagatctgcgtcgtcggcctccacaccatgcctcaggccggcatcggctacatccccggcagcctcctcaacgagggcgaccccgtcgccactagcatcgtctcctccggagggtaccttgacgacgaggacaccggcgacgtcctcgtctataccggcagcggcggccgccagcgcaaccgcgtcgaccaccacgccaaccagacgcttgagcgcggcaaccttgcgctccacaacagctacctctacggcgtggaggtgcgcgtcatccggggccacgacatcgaccaaggtccgcaccgcaaggtctatgtctacgacggcctctacagggtcattgagtccaccttcggccccggcaagtccggccacgacgtctgcaagttcaagcttgtgcgtctccccggccaggacgacctagccagcaagacctggcacaccgccaagctgctcaaggagtccatggacgccagaatccgcccgccaaggtacatctccctcgacctctccaagggggctgagcttcttcgcgtccctgtctgcaacaaggtggacaatgacaggtctcccctgctatttgagtacattgcccaacctgagtttccagtgcggccagcgcacgtgccagtcaagcagcacggcggctgccattgcgcggggggctgtggctccaagtgcagatgtgagaggaagaacggtggagagccagtgtatactgaggatgacattctggtgatggggagaccggtggtgtatgaatgcggtgctctgtgtgggtgccccatgacctgcgtgaaccgtgtgacgcagcgagggatgaagcaccggctggaggtgttccgctccattgagacaggctggggtgtcagggcgcttgacttgatacagccgggagcgtttgtgtgtgagtacactgggcatgtggttgttatggatgatcagccaggcagtgcattggagggtcgcagcatcatcgatccaaggaggtttccagagcgatggaaggagtggggagacgcctcggctgtggaaccaaacatgaagagactccagtttgcaaagtttgcaggaccaggttatgttcttgatgtgtcacataagaggaatgtggcctgctacattagccacagctgcacacctaatgtgtttcttcagtttgtattgcgtggcaatgaggacgagtcgttccctcacctgatggtttttgccatggagaccatcccacccatgcgtgagctgagcattgactatggaattgatatggagttgagtgcaatctgatgctggttctgaggcatcaatgtggggaaggcaggcttactagactttttggatgatagcgtaggcgacgattttttttttggggggaataataaccatacatgatacactggtttagttttgccctagtttgcacccttcaatagttaaattctagaattcagagtgacagagtatcaaaaggtgctca

SEQ ID NO: 761 - DNA, 2148 bp, Sorghum bicolor
ccgagcgagcgatcgatgtcgggctccggcgatcgtcgcggcggcgggcctcctggacccgatggtggctggaaaaccaaggggaagaactcgaagaaacacgggcaagtaggcgggagccaatggacaccggggagttccacaaatgcgacacctagtacagcaaggccagcatggggtggcaatggctcctcgcacccttctggaaggacttgggctcaagcttcagatcgtggtgctggcaacagatgcaatcctagaccgccaccaccaacactgcgccctgttgtgactccacctctggcaaatggttggcagtggcaatccaggcctcgtccatctggttctgaagtcgagaaggatgatgcttctccatctggttctgaccctgaggtggagaatgttgatggcaacaatgcatcagatgatgatgatgatttgagtgatgatatcagtgatgaatatgattctgatgcaagtgagaaaagttttgagactctaaaaacaaacaagtggttcaaaaaattctttgaaaaattgaatacattgagtgtggaacagataaatgaaccggctagggagtggcattgcccagcatgcaaaaatggacctggggcaattgactggtacagagggctgcaacctttaatgactcatgctagaacaaagggttctaaaagggttaggcttcacagagaattagctgcattgctgggagaggagctctctcgcaggggaacttcagtggtaccagcgggtgaacaatttgggaaatggaaaggactgcaagaaagcactgatcgggagatagtgtggccaccaatggttattgttatgaacaccttattggaaaaagatgacgatgataagtggaagggcatggggaaccaagagctccttgattattttggagaatatgcagcaactaaagcacgtcatgcatatggtccctctgggcaccgtggtatgagcgtgttaatatttgaaagctcagctgtgggctacatggaagctgaacgtctgcataggcactttgttaatcaaggtacagacaggaatgcatggcagctcaacaaggctcgattcgcacctggtgggaaaaggctgctatttggtttcttagcgagcaaagaggatatggaggcttttaacaagcattgccatggtaaaagccgtatgaagtatgagatgaagtcttacaatgagatggtcgtgatgcaaatgaaacagatgagtgaagacaaccagcaactgaattacctgaagaacaaggtggttaagacagagcagcactctaaagcagtagaagaatcattgggtgttgttagccagaagctacgtgagactatggaagagaatatatttatcaggagtaaagcaaaagagaagcacttggagtatgagcaagagatgaagtaccaggaggaattttttcatagtcaaattgaggatattcacaaggccacggaggacaaagaaaagctgtttgagaagttgctgcaggaggagcgctcaaaggctagacgatttgatgtagattctggaactaccgaagatcgcaagctaaggaaggaacatgtacagaagttcattgattgccaggtcaaggatgtggaaaagtttgaagctgagcgggatgagttgatcaaagtccacgatgagacgaagatgaggctcaagaaagagtacatggagaaggagctggagctggagaaggagctcgacgcagccctgacgggcctgatggagaagcacaagccagatagctttgaggcctccagctcgtaaaggggcttcagcggcttacctcagatcctcatcagcttggaggagcaatcttgtagatgctcctgcttatccataaaagaatgcctagacattctgtagatgttgctaaaccatggtgtccctgtggtggcagcaccgagttatatggtcgccgtagtggtatctcaatcgtattgtgtgcttcgaggatctgaacactgagcgttttgcccgtgatggcatatgggtcaaactacctggagtgtgctttggtttgaatgcgggtgttggttttgcctttcttatgccccggatcattactgattatgttgctccggtcatcaaagtgtctgattcagccatccgaggaaggtcggtttt

SEQ ID NO: 762 - DNA, 2112 bp, Sorghum bicolor
ttccgcacttccgctcactgccaaggcatctccattctccactgcaaatcgtaaaaccccacgacgctgtagcggagagaaaagggggagcgcgcgacgcgaacgcgatcgatgtcgggctccggcgatcgtcgcggcggcgggcctccgggttccgatggtggctgggaaaccatggggaggaagtcaaagaaacaagggcaagtaggtgggagacagtgggcatcatggaattccacaaatgcgacacctaacacagcaaggccagcatggggtggcaatggttcctcgcacccttctggaacgagttgggctcaagcttcagaccgtggtgctcctaacagatgcaatcctagaccgccaccacaaacagtgcgccctgttgtgactccacctctggcaaatggttggcagtggcaatccaggtctcgcacatctggttctgaagtcgagaaggatgatgctcctccatctggttctgaccctgaggtggagaatgttgatggcaacaatgcatcagatgatgaggatgatttgagtgatgatatcagcgatgactatgattctgatgcaagtgagaaaagttttgagactcgaaaaacgaacaagtggttcaaagggttctttgaagtcttgaatacattgagtgtggaacagattaatgagcaaactaggcaatggcattgcccggcatgcaaaaatggacctggggcaattgactggtacaaagggctgcaacctttaatgactcatgctagaacaaagggttctacaagggttaggctgcacagagaattggctgcattgctggaagaggagctctctcgcaggggaacttcagtgataccagcgggcgaacaatttgggaaatggaaagggctgcgagaaagcactgatcgggagatagtgtggccaccaatggttattgttatgaacaccttcttggaaaaagatgacgatgataagtggaagggaatggggaaccaagagctccttgattattttggagaatatgcagcaactaaagcacgtcatgcctatggtccctctgggcaccgtggtatgagcgtgttaatatttgaaagctcagctgtgggctacatggaagctgaacgtctgcataggcactttgttaatcaaggtaaagacaggaatgcatggcagctcaacaaggttcgattcgtacctggtgggaaaaggctgctatttggtttcttagcgagcaaagaggatatggaggcgtttaataggcattgccatggtaaaagccgcctgaagtatgagatgaagtcttacaatgagatggtggtgatgcaaatgaaacagatgagtgaagacaaccaacaactgaattacctgaagaacaaggtggttaaaacagagcagcgctctaaagcagtagaagaaactttgggtgttattacccagaagctacgtgagactatggaagagaatatatttgtcaggagtaaagcaaaagagaagcacttggaatatgagcaagagatgaagtaccaggaggaattttttcatagtcaaattgaggatattcacaaggcaacagaggataaagaaaagctgtttgagaagttgctgcaggaggagcgctcaaaggctaggcgctttgatgtagattctggaactacggaagatcgtaagctaaggaaggatcatgtacagaagttcattgattgccaggtcaaggatgtggcagagtttgaagctgagcgggatgaactgatcaaagtccacgaggagaagaagatgaagctcaagaaagagtacatggagaaggagctggagctggagaaggagctcgacgcagccctgacggtcctgatggagaagcacaagccagatagctttgaggcctaaaacattgtgtccctgtggtggcagcttgcgtgatacggagacgtgaccagcatcgcgttatattgtcgctgtagtagtatctttcagtcgtagtgtgtgtggttcgagcatctgaagttctgaacacagtgtttgcctgtgatggcatatggatcaaactacaactggagtgttatgtcatcctctatgggcgtgcgactgtcgaagtgcctaattcagctattaggattgacctgc

SEQ ID NO: 763 - DNA, 3907 bp, Sorghum bicolor
atgggatcgctgcggggcgcggcagccccgtccccggcgccgcgcgcgggcgacctggtgaccacgcaggttagcctgggcggatttgacgccaccgtcaaggcgctcgatcttgccgactttctcgagttgaaggcgggcttggtctggcgctgccgcgtcaagacctcctggaccccgccggacgcctatcccgacttccttctccccaccgtcacctccgccgccgcgcagccgccacagtacgatcgcgtgcctccgcacgccttcgtccactttgcgcgcccggagggcgcgcgcgccgccgccgacgcagcggggcggtccgagctcatcctctccgggaaacccctgcgcgccgcctccgcgcaggagagctcccttcgggcctcccgccgccgcagtgtctcgccattccgcttccctggctcacgcctcgaggtcggggatctcccggccaaggacgccttcctcgccgcctggcgcggtccggcctctgggctcgagttctccgtcgatccgttcgacgggtcttgccgcctcatcttcgcccgcgacaccgcattcaaagtccgggagttccgcgagtctgtggtcatgcgctgcgacgtcaagctcgagttccccgtacgcgacgtcgccgaagtcagggtgttccggctcgactgctcgctgctgatccggctgtcggcggcaccgctggtttattaccgcacggcggacgacgacatccacgagtccgtgccgttcgacctgctcgacgacgatgacccgtggatacggaccacggacatcacccccagtggcgcgattgggcggtgcggcgcgtatagaatcacattctcgccgcgcttctggccaaagatggaacgcgcgctggcgtacatgagggataggagggtgccgatcgttgattgcggtggtggttggggggccaggaggggcctcaccgtgcgagatgagcctgagtttggggagcgaatgcaggacctgttcttctgcgtgcagcactccgagggtctcaagtttccggtgttgttcctcgtgaatgctctggtgcacaagggagtaataaatcaacaccacctcacgcctgaattcttcggcttgctccagaggaaggaggatgatgtgaatgtggctgctttgagggaattttggggggacaaatttccagtttttgatgcatgtggcaggctgaagaatctgcaagatagggttgccaggtaccccaaacttcttcgcaacaagattggggatgacaattcagaggtgaggaggctggtagtcacgcccaccaaagcttattgcctgccaccagaagtggagcgctctaatcgtgtcatccgtcattatcgtgaagtcacagacagatttctcagggttacttttatggatgagggtatgcagctactgaacagtaatgtgctgaatttctctgctgcgcaaattgtcaaagatttgatgtcaaactcgttcctgcataagacaacagtgtacaagcgtattaaaacatttttgacagagggattccacatgtgtggtaggaagtactcatttcttgcattctcatcgaaccagctgagggacaggtcagcttggttcttcgcagaggacagaatgagaacagtggaaaccattaggaaatggatggggcggttcacaagtaagaatgtagcaaagcacgctgctcggatggggcagtgcttctcatctacatatgctacagtggtgatgcagccgcatgaggtcaatgagtgtctcgaggaagttgaacgcaatgggtacattttctctgatggaattggcaagattacgtgtgaccttgcacttgaagttgctcagaagctgcgattgacagataatcccccatccgcttaccagattaggtatgcaggcttcaagggtgttatagctgtctgggaaggagaaaatgatgggatacgactttccctgaggccgagcatgcacaagtttgagtctaaccataatgtgttagaggtggtctcatggacaaagtttcagccaggattcttaaaccgtcagattattacattactgtcctccttgaatgtcccggatgctatcttttctcaaatgcaggaagccatgttgtctaatctcaataatattttgtcggacactgatgttgcttttgacattgtaaccacctcttgtgctgagcaaggaaacactgcagcactgatgttgagtgctggcatttcacctggaactgagccacacctgaaagcaatgctgttagctataaggtcctcacagctactgggtcttttggagaagacaaggatttttgtgccgaaggggaggtggttgatgggctgccttgatgaacttgggatccttgagcaaggacagtgctttatccgggcgtcatctccatcactcaataattgtctggtaaagcatggaccaagattttcctcagcaaacaaaaatgcagagaccattgtgggtactatcgtaatggcaaagaatccatgccttcatccaggggatgtccggatccttgaagctgttgatgtgcctgaactgcatcaccttgttgattgcttggtcttccccaagaaaggtgagaggccacatgccaatgaagcatctgggagtgatcttgatggggatctctactttgtgacatgggatgaaaaccttataccacctggcaaaaagagttggaaccctatggactactccccaactgaagcaaaacaactaccgcgcgcagtatccccacatgatattgttgatttcttcttgaagaacatggtaaatgagaaactgggtccaataagcaatgctcatgttgttcacgctgatatgagcgagtatggagcaatggatgagaagtgcattcagttggcagaactagcagcaactgctgtagacttccccaagactggcaaaattgtgtcaatgccaccatcccttcggccaaaattatatcctgacttcatgggaaaggaggatgccatctcctataaatcagagaagatccttggaaggctttatcggtcaatccaagaagcctccagtggtgatttggttccagaagaaacttgcacattaaacgatttgccttatgatgcagatatggaagttcctggtgcaactgattttctctcaagtgcttgggagtgcaagtgctcatatgaaacacaactgaatgcactgctcaaccaatatggtgtgcgcactgaagcagagcttgttacagagcacatatggtcgcttcccaaatacagcagcagaaaacagggggacataaaggagagattgaagaatgcatactctgctctccacaaggacttcaggagcattttcgaaagctttgttacagatcaaactgagatctctgatgatgagaaaattcggttttatgagatgaaggcctctgcatggtaccaggtaacctaccaccccaaatgggtccaaaagtcaagggaaatgctcaaacctgactttgaggacatgccagcaaggcttagctttgcatggatcggggtcgagcacctggcacggattaagataaggtgccatggagaagtgaaagtggacagccgaaggcccgttgagaggctcgcagcctacatatctgggagcatgtgagctggcgtgaagctccatgcaatagtgaagcaagaccactctgcccctttctgccatgccatctgaactctgaagcatggctccgcctagtcacttcgtttttttgttttgttttttttacgaaattacatagttgggacacagacactctatatgcacgtacaccgtatacttatctctatgaaccaacattaatgcatttaccagagtcgaacttgtccaaactctattactaccagaatgtttgtggatataaagtattagttcatggtgtctgaattcc

SEQ ID NO: 764 - DNA, 3663 bp, Sorghum bicolor
atggtggtgtcgccggcggagccagtgactacccgtgtcagtgtgggcggctttgactctcgcttcacctcgccgcgcgaactcgccgactacttggaggccgtggccggccgggtctggcgctgccgggtcaagacctcctgcacgccgcccaactcctaccctgacttccagtgcctcccactactccccgcggcgaacgcgcaccagccgccgccgcattattcgtccagggcgcggcgacgccgagctccagacggtgaagacgacggcgcgctcgcgttccaggccgcgccgacgccgtacaatctggtgcccccgcacgccttcgtgcacttcgtgcacccggaggccgcgcgccgcgccgccaggtccgggatcctcgtgcgcgcctcctcctcgtcccagaacaagagcagcgccgccgtccgagaccgcgcggtgcggcgccagaacgccaagccgttccgcttcacgaacgcgcgcgtcgaggtgggcaacctctgggcgccggacgccttcgtcgtctcctggcgctgcccggggaactccggctccagcgccagctccggcctcgacttcgtcgtcgacccgttggacggcagctgtcggctgctgttctcccgtgacaccgcgttcgcgttccctgcctcccgcgaggccgcggtggtgctgcgctgcgacttcaaggttgagtttttcgtcgacgacatcgccgagctcctggtgttcccgaccgatgactcgctgctgctccggctctcggccgcgcccctgctgtactaccgcacggcggcagatggtgtccaccagtcggtgccttttgacttgctggacgacgacgacgacgatccatggatacggaccaccgacatcaccgctagtggagccattggccggtgctggatgtacaggatctccttcaagacgtggttctggccaaagatgaaggacgcactggcgtacatgaaggagaagagggtgccggccgtggtctgcgacattgggtcgccggggttcagggtgcacgacgagccggagtttgggaagccaatgcaggaccttttcttgtgcgtgcagcatgtcgaggagctccagttttcagtcttgttcttggttaatgtgctggtgcataaggggatagtgaacgagcaccagctcacgtccaaattcttctctttgctcaagagagaagaggagcaagtgaatgtggctgcactgacggagctgttaggagagaattctcaggtgtttgatgtatgctggaggctgaaaaatgtgcaggattgggttgccaagaatcccaaactaattcatcctcgcagcaggggcaaggttgctggtgattataatgctgtggtgcggaggctggtgatcactcccaccagggcatattgtatgccgccacaagtagagcgctctaaccgcgtcattcggcactatcatcatgtggcagatcggttcttgagggtaacctttatggatgaaggtatgcagctgctgaacaacaatgcactcagcttccatgccgcaccgattgtccagagcatgatgtcaaaattgttccagcataagacaagaatttacaggcgtgtgcatacacttatgacaaagggtttccacttgtgtggtaggaagtactctttccttgcattctcatcgaaccagatgaaggacaggtcagcttggttcttcgcagaggagggaacaacaactgctgcaaccattagggagtggatgggacagttcccaagtaggaatgtcgcgaagcatgctgctcggatggggctgtgtttcacatcttcatatgcaacggttgtgacacggccgaatgaggttaatgagttgcttgaggatatcgagcgcaatggatacaatttctctgatgggattggcaagatcacaccggaccttgcaatcgaagttgcggcgaggttgccactgatagataggtaccctccatctgcgtaccagattagatatgcaggattcaagggtgttatagctgtctggccaggacaaaatgatgggatacggctttcccttaggccaagcatgaggaaatttgagtctacccactctgtgatagaagtagtatcctggacaaaattccaacccgcattcttgaaccgtcagattataatattgctgatgtccttgggtgtcccagaagctatattttgggaaatgcaggaggcgatgcttaagaatctcgacagaattttgtcagacagagagattgcttacaaggttgtaacaaacagttgccctgagcgtggaaccatcgcaagactgatgctgagtgctggatttagtcctgcaaccgagccacacctgaaggcaatgcttttggctataaagtcctcacagctgaagggtcttttgaagaaaacaaagatttttgtgcccaagggaaggtggctgatgggctgcctggatgaacttggaatccttgagcaggggcaatgctttatccaggcttcatctctatcaatcaacaatcatttcatgaagcatggctcaagattttcctcagcaaacaagaatgcagtgacaattgtaggtacagttgtggttgcaaagaacccatgccttcatccaggggatgtacgtgttcttgaagcagttgatgtgcctgaactgcatcaccttgttgattgcttggtcttcccaaagaaaggtgagaggccacaccccaatgaagcttccgggagtgatcttgacggggacgtctactttgtgacatgggataaaaatcttgtacctccggggaaaaggagctggaaggctatggactactctcctgctgaagcaaaacagctacaacgaagagtacttcagcatgatctcattgatttcttcttgaagaacatggcaagtgagaacattggtcggataagcaatgctcatgttgtccatgctgacattagcgagtacggagcaatggatgagaaatgtattcagctagctgaactagcagccactgcagtggactttcccaagaccggcaaaattgttagaatgccaccatcccttcgcccaacaaaataccctgacttcatggaaaaggatgatgccatctcctataaatcagaaaagatcattggaaagctttaccggacggttagatattatatccttggaatgcccttggaaagtttgatcaaagatggcatgccagcttacgatatcgacctggaagttcctggtgcatcgcatttcttcctagatgcctggcaatggaaatgtgcatacgaatcgcggctgaatgcgctgctcaatcagtacagcgggtgcaccgaagcagagcttgtgacaggggtgatctggtcgcttgccgatggaaggaaaaggaagaagcatgaggcaaacgagaagttcagccatgcatatcctgaactccaccaggagttccgacgtgtctttgaaaatattgcagcagatcaagataggatgtctgatgaaaagaaaaatctagtgtatgagatgaaggcctccgcgtggtaccaggtaacgtatcacccagaatggatcagattctcaagggaaaaggagccgcatggtgaggaaaggccagcaagactcagtttcccctggatcgccatagattacttggcgtgtataaagatgaggtgccgtggacaagcaaagcattttacttga

SEQ ID NO: 765 - DNA, 3720 bp, Sorghum bicolor
atggcggctcacaatcgcagtcgaagccccgagtcaactcgccgtcgtgctcatcttcatcgctctctcaagccatccaagcccaaccaacaccatcctcgtgaacgttgtcgacaaaccgcaggccacccgttgccaggatgcaatttcgctatggtgtggccgacagggcttgcgacgcgggcgatcctgaccggcttcgacgccggcctctcggcgcgtggcctcgcagatgacttggagcatgtggcaggcacggtctggcgctgccgggtcaagacttccatcacgccgcctaagtcctacccggacttccatctacctgccatccttgctgccgcggtgctccacccggacgggccgtcgcggcacggtcgcgtggcccctcacgccttcgtccacttcgagcagctcaaggctgcgaaccacgccggtgacttcttcaagatgcgaatctctgcgcagaacacctacctactacatggccgagcggcctgcccgcgagacggtggcaccgacatgaggcgcccgatgctcttcccggactcgtgtgtcgagtttggcgacatcgtgccgcccgacaccttcttcgtcgcctggcgcgggaccgaccactccgcctcggcagttgacttcatcgtcgacccgtccgtcggttgctgccggctgctgttctctcgcgacactgccttcacgttccccgacctctgccgtcgccccacagtggtgctgtgctgtgacatcaagctcgagttctccgtcagcaatgtcgctgaggtcctggtgttcgaggctgatgactcgctgatcctacggctctcggccgcgcccctcgtgtactaccgcacggcaggcgacgacgtccaagatcgcgtgcccttccacctgatcgacactgacgacgacccgtggatacgaaccaccgatgtcaccccaagtggtgcaatcggccggtgctcggcgtatcgggtctccttcggagcaatgttctggccaactatgaggaccgcactgaagtacatggagaggcagggggtgcctgttgacgttcgagatagccgttggctggggttcaccgtgcttgaggagccggacttcgggcggccaatgcagcacgtgttcttctccctgcggcaagatgaagacctgtggtttccggagctgtacttggttaatgtgctgatccacaataggatagtcaatctgcaccagctgacgtctgagttcttcagtttgctgaggagagcacatgaagatgtcaatgttgctgcgttgacagaattgtttggtgcaaagcttcaagtttgtagtaatccatgctcgaggttgaagaacgcgcaggatagggcgaccaagaatctcaatcttctctttcatggcagcagcagaaagcttggtgatttcaatgctgaggtgcgaaggctgatcatcactcccaccaggacatactgtatgccacctcaactggagcgctctaaccgcgttacccggcattatcatcaattgtcagatcgcttcttgagagttgcttttgtggatgagggtatgctgccactgaacgctaatgcattgagcctccaagtggtgcctcttgttaaggacttgatgtccagccctacccaacagatgacaacagtttacaggcgtgtccaaacaatcttgacagagggattcaccatgtgcggcaggaaatactcgttccttgcattttcaacgagccagctgaagcaaaagtcagcttggttctttgctgaggatggaacaacaactgtcgcaagcatgaaggagtggatggggcagttcccgattaggaatcctgcaaagcacgctgctcgaatggggctgtgcttcacatcttcgtatgcaacggtgacaatgcagccttgtgaggtcgatgagtatcttgaggatgtcattcataatggatacaatttctctgatggaattgggatgatcacgcaggacctcgcgttggaagttgccaagaggttacaactaacagatatctacgccccatccacataccagattagatatgcagggttcaagggtgttgtagctgtctcgacgggacaaaatgatgggatgcggatgtctcttaggccaagcatgaggaagtttgagtctgcacactctgtgttagaagtgctgtcctggacaaagtttcagccatctttcttgaaccgccagattataacattgctgaccagcttgggtgtcccggatgctgttttttggcaaatgcaggaagcgatgctaggtaatctcaaaaggattttatcagacaacaatgtggcgtatgaggtcgtgacaaactcatgtcctgagcatggaagtactgcaggactgatgctgagtgctggctttgctcctgcaactgagccacacctgagggcaatgctattggccatctgcgcctcacagatgcagggtcttttggataaaacaaggatttttgtgccaaagggaaggtggttgatgggctgtcttgatgaacttgggatccttgagcaaggacaatgttttatccaggtctcaacaccatcactcaacaactgttacgtgaaccgtggttcgatatttccatcggaatacaaaaataatgcagagattattgttggtacagttgtaatggcgaagaacccatgccttcatccaggggatgttcgtatccttgaagcggtggatgtccctgaactgcatcaccttgttgattgcttggtcttcccccaaaaaggggagagaccacacgccaatgaagcttctggtagcgatcttgatggcgacatctattttgtgacgtgggatgaaaatcttgtacctcctgggagacagagcggcacccctatggactacttcccggctaaaacgaaacaactaccacgtgaagtacatcaatctgatatcattgatttctacttggagagcatggtaaacgacaaccttggtcgaatatgcaatgctcatgttgttcatgctgatcggagcgatgatggagcaatggatccgaagtgcattcagttggccaaacttgcagctattgctgtggactccgcaaagactggggaaattgtgagaatgccaccatccctttcaccaaaagaatatcctgacttcatgggaaagggggatgccatctcctacaaatcaaaaaagatccttggaaggctctatcgatcaattctaagggaaaatggcgatgattttgtgtcacaaggtacatgcatttcaaatgagactccatatgacattgatctagaagttcctggtgccttaagttttcttgaggatgcttggcaatgtaagtgcctgtacgaagcacaactaaataccctgctcagtcaatatggtctgcgtagtgaggctgagcttgtgacaggggagatatggccactagtcggatataacaagtatcaatatcaattaaaagagaggatcaactatgcatattccaaactccaccaagagttccgaagtatctttgaaagcattgatatctcctattgtgacaacaaaaacctagcatatgagatgaaggcatctgcatggtaccaagtaacgtatcaccccgaattcatccgattaagggagcctgatgatgagaaaacacctgcaagacttagttttgcatggattgcagttgattacttggcacaaataaagaagaagtgtcatggagaaatgaaagttgaagagggaaggtcagcctacattttctaa

SEQ ID NO: 766 - DNA, 3756 bp, Sorghum bicolor
atggcggcgcacagccgccgcagtcgcagtcgcagccccgagtcggctcgccgtcgtgctcatcttcaccgctctctcaagccatccaagcctacccaacaccaccttcacgaaagccgccgcctgcaaaccgcagaccgcccgccgctgggacgcaacaacttcgccgccgtggcgtggccgacggagccggcgacgcgggtggtcctgaccggcttcgacgccggcctctcggcgcgtggcctcgccgacgacctagagcatttggccggcacggtctggcggtgccgggtcaagacttccgtcacgccgcccgagtcctacccggatttccagcttcccgtccaccctgccgacgacgacgacgcagcggtgttccaccaccaggacgagccgtcgcggcacggtgtcgtggcccctcacgccttcgtccacttcgagcaccccaacgccgctgaccgcgccggccacttcttcaggaagcgcgtccccgcgcagagcagctacctactacatggccgggcggcccgcccgccgcgggacggcggcactgacgacaccagggggcggccgatgctgttcccggactcgcacgtcgaggtcggcgacgtcgtggcgcccggcaccttcctcgtcgcctggcgcgggaccgacgacgactccgcctccgcctcggcactcgacttcgtcgtcgacccgtccgccggttgctgccggctgctgttcgcccgcgacactgcgttcacgttccccgatttccaccgccgcccggccgtgctgctgtgctgcgacgtcaaggtcgagttctccgtcgccgacgtcgccgaggtcctggcgttcgaggcagatgactcgctgctcctgcggctctccgccgcgcccctcgtgtactacagaacggcgggcgatgatgtccatgaccgcgtgccattccaccagatcgacgttgacgacgacccgtggatacggaccaccgacgtcaccccaagcggcgcgatcggccggtgctcggcgtatcgggtctccttcgcggcgaggttctggccaacgatgagggctgcgctggagtacatgaagaagcagggggtgcccgtcgacgtctgtgacagccggtgccggggggtcaccgtgcttgaggagccggacttcgggaggccaatgctggacgtcttcttctccctgcggcacgacgaaggcctgcggtttccggagttgtacttggttaatgtgctgatccacaacgggatagtcaatccacaccagctgacgtccgagttcttcagtttgctgaggagggcacaggaagatgtgaatgtggctgcgttgacagaattgttcggcacaaagcttcatcaagtttgtaatgatccatgctcaaggttgaagaacgcacaggttagggctgccaagaatctcaatcttctctcaaacagtagcagcagaaagtttggtgattacaatgtttttgaggtgcggagactgatcataactccaacaagagcatactgtatgccacctcaagtggagcgctctaaccgcgttacccggcattatcgtcaagtgtcagatcgcttcttgagggttacttttgttgatgagggtatgctgccgctgaactctcatgcattgagcctccatgtggtgccttttgttaaggactcgatgtccagctcgtcccaacagatgacaacagtttacaggcgtgtccaaacaatcttgacagagggattcaccatgtgcggcaggaaatactcgttccttgcattctcaacgagccagctgaagcaaaagtcagcttggttctttgctgaggatggaacaacaactgtcgcaagcatgaaggagtggatggggcagttcccgattaggaatcccgcgaagcacgctgctcgaatggggctgtgcttcacatcttcgtatgcaacggtgacaatgcagccttgtgaggtcaatgagtatcttgaggatgtcattcataatggatacaatttctctgatggaattgggataatcacgcaggacctcgcgttggaagttgccaagaggttaccactaacagatatctacgccccatccgcgtaccagattagatatgcagggttcaagggtgttgtagctgtctcgccaagacataatgatgggatgcggatgatgtctcttaggccaagcatgaggaagtttgagtctgtacaccctgtgatagaagtggtgtcgtggacaaagtttcagccagctttcttgaaccgccagattataacattgctgaccagcttgggtgtcccagatgatgttttttggcaaatgcaggaagcaatgctaggtaatctcaaaaggattttgtcaaacaccgatgtggcgtacaagattgtgacaagttcctgtcctgagcatggaagtaccgcagggctgatgctgactgctggctttgctcctgcaactgagccacacctgagagcaatgctattggctatctgtgcctcacagatgaagggtcttttggacaaaacgtggatttttgtgcccaagggaaggtggttgatgggctgtcttgatgaacttgggatccttgagcaaggacagtgttttatccgggtctcaacaccatcactcaacaaccattacatgaatcgtggttcaatatctccgtcggaatacaaaaataatgcagagattattgttggtacagttgtaatggcgaagaacccatgccttcatccaggggatgtccgtatccttgaagcggtggatgtgcctgaactgcatcaccttgttgattgcttggtcttcccaaagaaaggggagaggccacactccaatgaagcttctgggagtgatcttgatggcgacgtctactttgtgacgtgggatgaaaatcttgtacctcccgggagaaagagttgcacgcctatggactactccccatctaaatcaaaacaactaccacgggaagtacatcaacaagataccattgatttctacttggagagcatggtaaatgacaaccttggtcgaatatgcaatgctcatgtcgctcatgctgatcggagtgatgatggagcaatggatacgaagtgtgttgagttggctgaacttgcagctattgctgtggactccgcaaagactggagaaattgtaaaaatgccaccatccctttcaccaaaagaatatcctgacttcatgggaaaggaagatgccatctcctacaaatcaaaaaagatccttggaaggctctatcgatcaattctaatggaaaatagtggtgatttgctgtcacaagtcacatgcatttcaaatgagaatcaatacgacactgatctagaagttcctggtgccttgagttttcttgaggatgcttggaaatgcaagtgcttgtacgaagcacagctaaataccctgctcaatcaatttggtgtgcacagtgaggctgagcttgtgacaggggagatatggtcacttgttggatataacaagaagtatcaatatcaattaaaagagaggctgaactatgcatattccaaactccaccaagagttccgaagtatctttgaaagcattgatgtctcctatggtgacagcaaaaacctagcatatgagatgaaggcatccgcatggtaccaagtaacgtatcaccctgaatttatccgattaagggagcttgatgatgagaaaacacccgcaagacttagttttgcatggattccagttgattacttggcacaaataaagaaaaaagtgtcatggagaaatgaaagttga

SEQ ID NO: 767 - DNA, 3408 bp, Sorghum bicolor
atgtcgatggcggctcccgcgccgggcgccacggccacggtgcgggtagccaacatcccggcctcggccatcgccgccgagctgctcgccttctttgactccgccgtcaccaccaccggcgcggccttcgcttgcgagatcgccgccgcccaccgcggctggctcagccgcggccacggctccgtccagtttgactcctccgccgccgccatccatgccatcgacctcgcctcctcgggccgcctgccccctttcctcggctcctgcctctccgtctcccccgcccacgccgacctcctgccccgcgcgcctgacctctccctccgcgccgccgacgcgggcctcattctaggcaaccgcgtcgccgagcgagagctggaggcggcctactcctgggacggcgtgcgggccgaggtcatcccgaggaagcggcgtgtggacctctacctgaagcaggattcccggagctacaagcttgaggttctctttgaggacatcagggagtgctttgggtgccaccttgatgggacgggcgccatcttgctgcagctgacttatgcaccaagaatatacactgcaatttctgggtcaacagttaaatcgaggtttacagatgaccgctttcatgcatgcaaggaggatgccaaatttgcatgggtcagagcactagattttacacctaataactctttcggcgagtgttccactcttgtcctgaaactgagcaaaggtgtaccagtatcagatattcttgaaagtttacccttctcaggagaattagaggaattggccatttcttcgatgcttgcatttggctcctcctccaatgtggttcctcttgttgactgcccgaatggcttttccgtgccttatgaagttcttttccgtctgaactctcttgttcacatggggaagctagttgccaggcatgttaatgctgatctgtttaaagtccttgaagagctgtcaattgatactttaaggagaatatttgagaaaatgagcaaattaaaatctacctgctatgaacctttgcaattcatcagacatgaggctcatagcatgagtaagagcaagaaagcctttttgtccaacaagaaggacggtggaaaattgatgaggtgttacagaattcacatcacaccatcaaaaatatactgcttgggacctgaggaagaagtttcaaattacgtggttaagtaccactctgagtatgcttctgactttgctcgagttacttttgttgatgaagactggagcaagctttctcccaatgcattatcagctagaactgaacaaggtttcttttctacacctttgaaaactggcctgtatcatcgtattctctccattctaaaggaaggattttgcattggcccaaaaaaatatgaatttttggccttttcagcaagtcaacttcgtggtaattctgtttggatgtttgcttcaaataattctttgactgctgagagtataaggaggtggatgggccacttcgaagatatccgttcagtctccaagtgtgcagctagaatgggccaactgtttagctcctccaggcaaacatttgaaatctcatcatatgatgtagaagtaattccagatattgaagtcacaagtgatggcactaaatatatattttcagatggtatcgggaagatttctactagatttgccagacagattgccaagttatttggattagaccctgctcaccctccttctgcttttcaaataaggtatgggggctataaaggagtcatcactattgaccctacttcctttttcaacctttctctacgacctagtatgaagaagtttgagtcgaagagcactatgctgaacattacaaattggagcaagtctcagccatgttacgtgaaccgtgaaattatttctcttctttcgacattggggataaaggatgaagtatttgaatcgatgcaacaagatgacatgcacgaatcagacggaatgctaacaaataaagaagccgctttgtctgtcctagggaaaattggtggtgctgataccaagacagcttctgagatggtgctgcaaggctatgaaccaagttcagagccttacctgttaatgattcttaaagcccatcgggctaataggctgaccgacataagaactaggtgtaagattcatgtccagaaaggccgtgttcttattggttgtttggatgaaacctgcacattagactatggccaagtttacatcagaattacaaagaatcgcaaggagcagaagtacagtgaacagccattcttttgcaatgatgatggcaaaacagctgtaattgttggaaaagttgcagtcacaaaaaacccatgtctccatcctggtgatgtcagagtacttgaagctgtatatgaccctgcattggatgctaggggtcttattgattgtgttgtatttcctcagagaggggaaaggcctcatccaaatgaatgctcgggtggcgatttggatggcgacctcttctttattacttgggatgacaaactgattccggagaaggttgatgcacctatggactacactgcaacgaggccacgcataatggaccatgctgttacactcgaggaaattcagaagcacttcgtcaattacatgataaatgacgccctcggtgttatctccaccgcccacttgatccacgcagaccgtaatccgctgaaagctcgcagccccgagtgcctccagctggccgctctgcactccatggcggtcgactttgccaagacgggagctccagccgagatgcccgtggcgctgaggccccgggagttcccggacttcatggaacggtgggagaggccaatgtacgtctccaccagcgtcctcggcaagctctaccgcgcagccctgcgccatgaggagaacgcagaagcgctcctgcctgcgggcccaccgcgctgcgtgtacgacccggacctcgaggtcgctggtttcgacaagttcctggacaccgcggaggagcagtacgaggtgtacgccgagaagctgggcaccctgatgacatactactccgcggagcacgaggacgagatcctgacgggcaacatccggaacaagctggtgtatctgcggcgggacaacaagcgctacttcgagatgaaggaccggatcatcgccgccgtcgacgccctgcacgctgaggtgagggggtggctcagggctcgcaaggaggatgacgcgtccaagttggcgtcggcgtggtaccacgtgacgtaccacccggaccgccgcggcgagaagcggttctggagcttcccgtgggtcgcctgcgacaccctgctggcgatcaaggcggcgcgtaggtgccggaagcgggtggaagacgccgctgcgcccatggactgcgacgcctcctagacggaggtgccactgtcaaag

SEQ ID NO: 768 - DNA, 4012 bp, Sorghum bicolor
atggaagagctacagaaggacggtgggcaacaatcaaatggctctgattctgaaccagaagctatggtgttggatgacaatggagcgggaaaatcccatagcatggatggaaacagggattctcctgtagatgtcgatgaaggccagtcatctatggatgtggatactaagggaaaaccatccctcaatgatgatgttaatggaaagtcttctgagccatattccaatgctccaattgacctgagtgtggaaagcctagagaagttttgcaaagaagcatcaaggtccttctttgatgaagttggtctgattagccatcagataaattcctacaatgactttgtctcgcatgggcttcaggagctttttgattcgctgggggaagtgattgttgaacctggctatgatccttcaaagaaaggatcaggtggctggaagcatgccatcatcaagtttgggagagtgaagcttgaaaagcctgtgttttggactggcaaggatgaaggttctgttgattttaagccttggcatgctcgtctccagaatatgacatatgcttcaagacttatagtagaagtgaatattcaggtttattctttggagaaaagtgacaaatctaaaacaggaaatgatggttttgttcaaaaaagggacttcatgaatgaaactcattggatatttattggcctccttccggttatggtgaaatcaaacttatgtttgttgcatagtctcaaggaaagcgagtgcttgttcgatgcaggtggatactttttggtcaagggaatggagaaggtattcattgctcaagagctaagatgtctaaagaggctctggattattgaccgtccttgctggatgatctcttttatgtctgaaatgaagcgtagacgtatatatattaaactagttgaatctacaaggagtgaagatttcagtgggagcaaaatcatttccatttcctttttgtatgcgacaatgccagtttggttgttgttctttgcacttggaatatcatcagataaggaagcctttgatgtgatagatatgcaagattgcgatgcttctgttatcaacacaatatctgcaactatcaaagaatctgatgaattgtgtgaagggtttcgtaaatcagataaagctcgtcaatatgttgatgagttggtaaaaagttcgagatttcctccagcggagtcctttgatgactatattgctaggtttctctttcctgatattagtggaaatagaaacaaagcacttttcttagggtacatggtgaaatgtctgctaatggcttttactgggaagcgtaaatgtgataataaggatgatttcaggaacaagaggctggacctacctggtgaattgcttggaagggaacttagggcacatcttaggctggcagagaagcgcatggttaaggccattcaaagagatttgaatagtgaccgtgagttacaagatcttgaacgctatatagatgcatcgattgttactaatggtctaagtcgtgccttttccactggttcttggtgccatccctacaaaagagctgaacggtgctcaggaattgttgcgactctaaggagaactaatcctcttcaaatgatgtctgacttgaggaaaacccggcagcgggttgcttatgctgggaaagctggtgatgcaagatatccgaatccatcgtattggggaaagctgtgttttatgtccactccggatggtgaaaactgtggacttgtgaaaaatctagctgttactgctattgttagctcaagggtggtgcagcccttgattgagagcttcatttcttgtggaatgagtaagctgaatgacattcctactgagcacattcaaagaatggataagatctttttgaatggcaattgggtgggatcttgtaaagattcagcttcatttgtatttcgattgaggtgcatgagacgcagcagtctgattgatcctcaggttgaaattaaaagggacaagcaccacaaggaggttcgtgtgttttctgatgctggacgaatcctcagaccccttcttgtggttgagaatcttaaaaaaatcagaaaaccaaaggggcgctcattctctttccaggaattaatgcaacaggaaataattgagttcattggtgttgaagaggaggaagatatacaatgtgcgtggggaatcaggcatttgtttgagagtgaaggagcgatatctagttatactcactgtgaactggatccttcctttcttctgggattaagctgcggtatcattccttttgcaaaccataattttgctcggagggtattataccaatctgaaaaacactcacaacaagctattggttactcaacgacaaatccacacatcagagttgatactctttctcatcaactatattatcctcagaggcctcttttcaaaacagttatagccgactgtcttggcagatcagattatactacttttggaagaaaagatgacttcatgagaccagaatacttcaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaagatagactttggaaaaacagaaagcaaaagaggacgtgttgacaatcttgatgatgatggcttaccttacattggtgcaagtcttcagaccaatgacatcgttattggaaaagtctcagaatctggagaagaccacagtattaagctgaagcatacagaaaagggaatggttcagaaagtattgctttcagcaaatgatgaagggaagaattttgctgtggttactctaagacaggttcggacaccttgccttggagataagttttccagcatgcatggccaaaaaggtgttgttggatttctagaatctcaagagaacttcccatttactcacaaaggtatagtcccggatattgtgataaatccgcatgccttcccgacacgtcaaactcctggacagctgcttgaagctgctctggggaagggaatagcctgcaaaggtacaatgagatatgcgacaccattcaccacagcatcagttgatgttattgcagaacagttgcacagggctggttattcacgatggggaaccgagaatgtactaaatggccgaactggtgaaagaatgcaatccttgattttcatgggccccaccttttatcagaggctgattcatatgtctgaagataaggtgaaattccgtaatactgggccagtgcaccccctcacgaggcagcctgttgccgacaggaaaaggtttggtggagttaagtttggagaaatggagcgtgattgcctcctcgcccatgggtcagctgccaacctgcatgaacgcctcttcatgcttagtgacttctcccagatgcacatctgccagacatgcgagcgtgtggctaatgttgtcatgaggtctgtctccggaggcaaaaagatccgtggcccctactgcggtttctgcaagtcttcggagaacatagtgaggatcaatgtgccctatggcgcaaagctgctctaccaggaactcttcagcatggggatctgcctcaagtttgataccgaagtctgctagaagctgctctacgcctctaccaggaactcttcagcatggggatctgcctcaagtttgataccgaagtctgctagaacttgtagacctgattgtatccagacatccagttatgtacataacgttaccctatgaggatagaggatatcgtactggcagctatgtgaaaattcctgccgatgtgtgctgctggcatagcaaggatgggcgagtgtgatgtagtgaaacggcactggcaggtgggtatctccaagcaggtgtggggatctacctctgctttgagaataaactctgttgaaactagaaaacctgtagcgtttatgctgtt

SEQ ID NO: 769 - DNA, 4272 bp, Sorghum bicolor
gcaccgcaacaccgccagaaccctccgtccctccctctcccacccactctacgaaggaacaagtgaagcgcgacggcggtcgcgccgcccgccgcctcccaccaccgctggcgccacgctgcctcgccgcaccgccagctgtccgccgaccccgctctccgcgtccgcgtccggcctaccgcagcttccccttcacccaccaggtataagctgccagtgcttgtgtaatggaagagctacagaaggacagtgggcaaccatcaaatggctctgattctgagccagaagctatggtattggatgacaatggagcaggaaaatcccgtagcatggagggaaacgaggattctcctatagatgccgatgtaggcaaggattctcctatagatgtcaatgaaggccagtcctctatggatgtggatattaaggcaaaatcttctctcaatgatgatgttaatggaaagtcttcttccgagccatattccaatgctccaatcgacatgagtgtggaaagcctagagaaattttgcaaagaagcatcaaggtccttctttgatgaagttggtctgataagccatcagataaattcctacaatgagtttgtctcacatgggctccaggagctttttgattcgctgggggaagtgatcgttgaacctggctatgatccttcaaagaaaggatcaggtggctggaagcatgccatcataaagtttgggagagtgaagcttgaaaagcctgtgttttggaccggcaaagatgaaggttctgttgattttaaaccttggcatgctcgtctccagaatatgacatatgcttcaagacttaaagtagaagtgactattcaggtttattctttggagaaaagtgacaaatcgaaaacagggaatgagggttttgttcaaaaaaggaacttcatgaatgaaactcattggatatttattggcctccttccggttatggtgaaatcaaacttatgtttgttgcatagtctcaaggaaagtgagtgcctgtttgatgcaggtggatactttttggtcaagggaatggagaaggtattcattgctcaagagcaaagatgtctaaagaggctttgggttagtgatcgtcctttctggatgatctcttttatgcatgaaatcaagcgtagacgtatatatattaaactagttgaatctacaaggagtgaagatttcagtgggagcaaagtcatttccatttcctttttgtatgcgacaatgccagtctggttgttgttctttgcacttggaatatcatcagataaggaagcctttgatgtgatagatatgcaagattgcgatgcttctgttatcaacacgatatctgcaaccatcaaagaatctgatgaactgtgtaaaggctttcgtaaatcagataaagctcgtcaatatgttgatgagttggtaaaaagttcgagatttcctccggcggagtcctttgatgactatgttgctaggtttctctttcctgatattaatggaaataggaacaaagcatttttcttagggtacatggtgaaatgtctgctaatggcttttactgggaagcgtaaatgtgataataaggatgatttcaggaacaagaggctggacctacctggtgaattgcttggaagggaacttagggcgcaacttaggctgttagagaggcgcatggttaaggccattcaaagagatttaaataatgaccgcgagttacaagatcttgaacgttatatagatgcatcgattgttactaatggtctaaatcgtgccttttccactggttcttggtgccatccctacaaaagagctgaacggtgctcaggaattgttgcgactctaagaagaactaatcctcttcaaatgatgtctgacttgaggaaaacccggcagcgggttgcttatgctgggaaagctggtgatgcaagatatccaaatccatcctattggggaaagctgtgttttctgtccactccggatggtgaaaactgtggacttgtaaaaaatctagctgttactgctattgttagctcaagggtggggcagcccttgattgagagcttcatttcttgtggaatgagtaagctgaatgacattcctacggagcacattcaaagaatggataagatctttttgaatggcaattgggtgggatcttgtaaagattcagcttcatttgtatttcgattgaggtgcatgagacgcagcagtatgattgatcctcaggttgaaattaaaagggacaagcaccacaaggaggttcgtgtgttctctgatgcagggagaatcctcagaccccttcttgtggttgagaatcttaataaaatcagaaaaccgaaagggcgttcattctctttccaggaattaatgcaacaagaaataattgagttcattggtgttgaagaggaagaagatatacaatgtgcgtggggaatcaggcatttgtttgagagtgaaggagcgatatctagttatactcactgtgagctggatccttcctttcttatgggattaagctgtggtatcattccttttgcaaaccacaattttgctcggagggtgttgtaccaatctgaaaaacactcgcaacaagctattgggtactcaacgacaaatccacacatcagagttgatactctttctcatcaactttattatcctcagaggcctcttttcaaaacagttatagccgactgtcttggcagatcagattatactgcttttggaagaaaagatgactacacgagaccagaatattttaatggacaaaatgcaatcgtagcagtgaatgttcatcaggggtttaaccaagaggattccctggttatgaatagggcttctcttgaacgaggtatgtttaggactgaacacctcaggagctataagacagatgtagaaaacaaggatggaaccaaacgattgaaattgaaggaaaagatagactttggaaaaacagaaagcaaaagagggcgtgttgacaatcttgatgatgatggcttaccttacattggtgcaagtcttcagaccaatgacatcgtcattggaaaagtctcagaatctggagaagaccacagtattaagctgaagcatacagaaaagggaatggttcagaaagtattgctttcagcaaatgatgaagggaagaattttgctgttgttactttaagacaggttcggacaccttgccttggagataagttttccagcatgcatggccaaaaaggtgttgttggttttctagaatctcaagagaacttcccatttactcacgaaggtatagtcccagatattgtgataaatccacatgccttcccaacacgtcaaactcccggacaactgcttgaagctgctctggggaagggaatagcctgcaaaggtacaatgagatatgcaacaccattcaccacagcatctgttgacgttattgcagagcagttgcacaaggctggttattcacggtggggagctgagaatgttctaaatggccgaactggtgaaagaatgcaatccttggttttcatgggtcctaccttttaccagaggctgattcatatgtccgaagataaggtgaaattccgtaacactgggccggtgcaccccctcacgaggcagcctgttgctgacaggaaaaggtttggcggagttaagtttggagaaatggagcgtgattgcctcctcgcccacgggtcagctgccaacctgcatgagcgcctcttcatgcttagtgacttctcccagatgcacatctgccagacatgcgagcgtgtggccaatgttgtcatgaggtctgttcctggaggcaaaaagatccgtggcccctactgcggcttctgcaagtcttcggagaacatagtgaggatcaatgtgccctatggcgcgaagctgctctaccaggaactcttcagcatggggatctgcctcaagtttgacaccgaagtctgctaggaacttgtagacctgcttgtatccagacatccagttatgtacataaagttagcctatgaggatatcgtactgggctactggcagctatgtgaaaactcgtgccgatgtgtgatgctggcatagcaaaggatgggcgagtctgatggagtgcaacggcactggcaggtgggtttctccaacccgatgtggggatctaccactgctctgctttgaggataaactctgttgaaactagaaaccttgtagcgtttatgtgctgtttcgccctgctcgtctgataaactatgctcaagtgaatgaacacttgtttcctgtttcttgcttg

SEQ ID NO: 770 - DNA, 3916 bp, Sorghum bicolor
gcgggaaccacaaatggatggtgatcagtcaactgttgtcttagatactgatatgatggattgcctgaatttcgatggctatggagatgttgaagatccccgcaaggagggtgcaaaaggggagcggcagccttctggcaaagttgatgaactgcagtctactatggatgtcgatttgacatgcatagcttatgtggaagatgaagggaatgaaaaacagaatgctatggatgtggatttgaaagaaatactgcctgaggaagatgaagggaaaggaaaggcttcttcagacataccctcacatgtaccagttgattttgatgttgcaagcctcgagaagttttgcagagaagcatcaagatcatttttcagtgcaactggactagttagccatcagattaactcatacaatcaatttgtctcccatggactccaagacctctttgattctcttggggaaatcactgtggagcctgattatgacccttcaaataaaagtggtgcttggaaacatgccactataaaatttggtagggttgagcttagtgagccagtgtttatggttgacaaccttgaccttgaacagcaagatctcaaatttaagccaagacatgcccgcctccagcggatgacatatgcgtctaggatgaatgtagaaatgactgctcaggtttatatactcgacaaaagtgacaaagccaagactggtaaggatacacatgttcatagaagagagataatgacagaaactaaacaagtcagcatgggattgttacctgtgatggtgaagtcaaatttgtgctggctgcataaacttcaagaaagtgattgccagtttgattttggtggctactttttgatcaaaggaacagagaaggtattcattgctgaagagcaaagatttttatcaaggatttggatcacagactaccccagttgggatgcaagttacctgtctcaaatcaaaagagaaaagatcaatataaaacttgttccgtccaaacgcaatgaaagctgcaaagtcataaccatttacttcatgggtacgattataccaatttgggtagtattttttgcacttggtgtatcgtcagacaaggaagcttttgatatgattgatatcctagactgtgatgcttccatagtcaacataatatcatcaactattaaagaatctcatgaagaatttgaaggcttccgcgctccaggtagagcctgtcaatatgttgataagctgatcagaaaatcaaagtttccgcccaaagaatcctttgatgagtatgtttgtaggtatatgtttcctagtgtcaatggggttaggagcaaggcacttttcttgggttacatggtaaaatgtctgctaatggcatactctggcaatcgaaaatgtgataataaggatgatttccgtaacaagaggctaggtctcgcctgccaattgcttcggagagaactctggactcatattaagagagcagaatggcgcatggttaagctcatgcagagagatttgagcaatgatggcaacttgcaagaccttaggcgttatgtggatgcgtcaattattaccaatggattgaatcgggctttctccactggttcttggcggcatccttatctaaaagcaaggtgttcaggggttgtagcaacccttcggagaacaaatccacttcaaatgatgtctgatctgaggaagacgcgacagtgggttgcgtattctggagcggttggagatgcaagatacccgaatccatccttctggggaaaattgtgttttttgtccactccggatggtgaaaaatgtggatttgtgaaaaaccttgctgttactgctgtggttagctctgtagtgaggaaaccattgattgatacatttgtttcttgtggaatgaagaaactggacgatatttcactacaagatatttctgggaaagacaggatcttcttgaatggaagcttgcttggagtatgtgcagacccacatgaattgactttgcgtttaagaagtttgaggcgtagcaagctaattgatcctcaggttgaaatcaaaagggacaagcaccataaagaagttcgtgtactttgtgatccaggcagaattctaagaccacttcttgtagttgaaaatctaagaagaatcacaagaccaaaagatggactatactcttttcaggaacttatagatcaaaacatagttgaactgattggtgttgaagaagaggaggatatccaatgtgcgtctggaattagacatctattctcaggggagaaagaagacaggtcttctggctatactcattgtgaacttgatccttctttcttgctagggttgagttgcagtctcattccctttgccaaccatgataatggtaagagggttctgatgcaagctgaaaaaatatcacagcaggctattggctactcccctacaaattctcacactaggctcgacaccctttcacatcaaatcttctatccacaaagacccttgtttaaaactgtggtgtcctatggtcttggaaaggcagagacagcctacagctttggacgaaaagatgactttaatacaccagaatatttcaatggccaaaatgcaatagtctcaatcaatgttcatcagggattcaaccaagaagattctctggtcctgaatagggcctctttagagcgtggcatgtttcgtacactacatttaaagagctataaagcacaagtcgaaaacaaagagatcacaaggcgtctcaaacacagggaaagtatcaattttggtaaagtgcaaagcaagagggggaaggttgacagtctggacagtgagggtttaccatatgttggagcaagtcttcaaagtggtgacattgtcattggaaaggtctcagagtctggtgaagatcatagtgccaaactgatgcatactgagaaagggatggtggataaggtagttctttcagcgaatgatgatggggtgaactttgcaactgttactctaagacagtctcgctcgccatgcgttggagacaagtttgccagcatgcatggacaaaaaggagtggttggcctattggattcccaggagaatttcccatttacttgccaagggatagttccagacatcgtcataaacccacatggttttccaactcgtcaaactcctggtcagttgcttgaagctgctctggggaaggggattgccatgggtgggaaggtcaggtatgcaacaccgttcaccactccaaccgtggacgtgatcaccgaacagctgcacaaggctgggttttcaaggtggggcgaggagagcgtcctgaacgggcagaccggcgagaggatgaagtccctggtgttcatgggaccgaccttctaccagcggctggtgcacatggccgaggacaaggtgaagttccggaacacggggccagtgcacccggtgacgcggcagccggtggaggacaagaagcggttcggcggcgtcaagttcggggagatggagcgcgactgcatgctcgcccacggcgccgccgccaacctccacgagcggctcttcacgctcagcgacttctcgcagatgcacatctgccaggcctgccagcgggtggccaacgtgatcatgaggcccgccgagggcggcagcaagaaggtgcacggcccctactgcatgttctgccgctccgcggagcgcatcgtccgcgtcaacgtgccctacggctccaagctgctgtaccaggagctcttctgcatgggcatctgcctcaagtttgacaccgagatccgctagaacaacgccatgccatttcatcagcccgtctctttttgaagccgtagactacatgcatttgcaattgcaacttggttgcctaggatattggtgattgaagtcgaccgtagactacatacatttttgtaactttgttgcctaggaaga

SEQ ID NO: 771 - DNA, 4524 bp, Sorghum bicolor
ggagattctcctcgccccttccactagagcagccgacggcccgaggcggcgagctcgtcggcgactgaccaccgccggagcagccgccgcctcctgctgggcctgtaccacagctcgcacgagcggctccggtggctgcgccagccgccactgtgctgtcggagggcggctcggaggacttgcgccccctcggcttctctgcgcccgccgcccctccgccggcgtgatcgaggatggagctacatcgtgaacttcctgaagctactctgaatgccataaaatttgatctcatgaccagtacagatatggaaaaattgagtagcatgagcgtgatcgaagtgagtgatgtcacaagtcccaagttaggactaccaaatgcttcgccgcagtgtgagacctgtggatcgaaaagtggacgcgactgtgatgggcatttcggtgtgactaaactggcggcaacagtgcacaatccatattttatcgatgacgttgttcactttctaaaccaaatatgtcctggctgtctcagtccaagggaaggcataaatatgaagaaggatggctctaaactttaccctagcgtaatctttaagacgctgtcaagtccaagagtattattgtccaagagtaaacttcacagaagccctagcgtgatggaaagaatttcaattgttgcagaagctgctgaaagagtgtctaatagatcaaagggtaaaggtttgcttgaaggcctgccccaggattattgggattttgtaccttctgagaataagcaagtccagtcaaatatgaccaagataatattgtcgccctaccaagtcttccacatgttgaagaaaagtgaccctgaacttatcaaacaatttgtttcaaggcgggagctattgtttctatcatgtttaccagtaactcctaattgccatcgtgttgtagaaatcggatatgggctttcagatggacgtgtaacatttttgtactctaaaaagacagatggggagacatctacagatccatctggaatgaaatggctaaaggatgctgttctcagcaaaagatcagataatgcttttaggagtactatggttggggacccaaaaattaagttatgggaaattggcattcctgaagatttagcctcaaacttggttgtttctgaccacgttaattcgtataattttgaaaatataaatttgaagtgcaacctgcaccttctaaccaaggaagaactatttattcggcgaaatggaaagttaatgtttcttcggaaggcagatcagctagaaattggtgacattgcctatagaccactgcaggatggtgatcttattctcatcaacaggcctccttcagtccatcaacattcactgattgcattctctgcaaaaattttaccaattcactctgtcgtatcaatcaatccactatgctgtacaccttttctgggagattttgatggcatgaagttcagttgtgataggatgttacacatcttaaacggtgaagtgcttacctgctcactggggtcgtcttggctgcaaaataacacgtctggtcttttctctgtcatgttcaaacagtatggttgcaaggcacttgacttcctttcttctgcacaagaagtattatgtgagttcttaaccatgaggggcttaagtgtatctctttcagacatgttctcagaccattactcaaggagaaaactaactgagggagttaagctggcattggatgaagctgaagaagctttccgaatcaagcaaatattgctagatccaattaacataccagttctgaagtgtcaggatgaaactgaagatgtaacttacagacaatctgattgtatccagaacaatccatcagttatcagatcttcaatcatggcatttaaagatgtcttcagtgatctattaaaaatggtgcaacaacatgttagtaatgataattcaatgatggtgatgattaatgcaggaagcaagggtagcatgttgaaatatgctcaacaaactgcatgtgttggtcttcaacttccagcaagcaaatttcccttcagagttccttcccaactctcatgcattagatggaatagacagaaatcgttgaactatgaagctgagggtactaatgaacgtgtgggaggtcaaaacctttatgctgtgatcaggaattccttcattgagggtttaaatccattggaatgtcttctgcatgctatatctggcagggcaaacttctttagcgaaaatgctgatgtgccagggacattgacaagaaaattaatgtatcacttgagagatatacacgttgcttatgatggaactgttagaagttcttatgggcagcaaatagtgcaattctcttatgatagtgctgatgatccggaagtatttaagtgtcacaaggctacaaattcaggggaccatattggtttgcttttcctgtcgaggcatttgaagaagtatagatatggtctggaatatgcatctctagaagttaaaaaccatcttgagcaagaaatgatgaagaaaaaaagattaggattgagatttgttatagaagaacttacaaaagagtataacgccaccagagatcagctaaagaatgcaatcccatcaatttgtatctcaaggagaaaatgtgtggtaggtgatgagggtgttaaaatttcagcatgctgcatcgctgtcgtagcactagctgaacctaactccatgtctcagttggacactatcaagaaaagggtgattccaatcatactggatacactgctgaaaggttttttggaatttaaggatgttgagatccagtgtcaacatgatggtgaacttcttgtgaaagtttgtatgtctcaccattgcaaaggtgggaggttctgggctactctacagaatgcttgcattccagtaatggagttgattgactgggagctgagtcgaccaagcaacgtagctgatattttctgttcatatggcatagactcagcgtggaaatactttgttgaatctttgaaatcagcaactactgatattgggaggaatattcgtcgggagcacttactggttattgcagatagcatgtctgtaactgggcagttccatgcaataagcagtcatggtttaaagcagcagcgcactcgtttatcaatctcgtctccattttctgaagcatgtttttctaggcctgcacaaagttttatagatgctgcaaagcaatgttcagtggacaatctgtgtggaagtctagatgcaattgcttggggcaaagagcctttcaatgggacgtcagggccttttgaaattatgcattcgggaaagccacatgaaccagaacaagacgagagcatctatgatttcctacgcagccctaaagttcagaatgttgaaaagaatcatttggatacgcgtagacaaagtactgaaaatgcttccatatgtaggttagcatgcaagtctaaaggcagtgcgactgtcaatggtgttgccataacttccgaccaggactttcttcatgctaaagtcagtatatgggataacattattgatatgcgcgcttccttacagaacatgctaagagagtacccgttaaatggatatgtgatggagccagataaatcaaaattaattgaggccctgaaatttcatcccagaggggctgaaaagatcggtgttggagtaagagaaattaaggtcgggttgaatcctaatcacccgggtacaaggtgcttcattttgctcaggaacgatgataccactgaggacttttcttaccacaagtgtgttcacggtgctgcaaattctatctcacctcaactcggaagttatttgaagaaactatatcatagagcataagatacaacattagttgcaccagtgctcctggcaatatcttgtcctgatcagaccatattaccaacttcttagaaggaactagctgtcacattttaggatgctcaaattgctcaaaacaagtataataacaggctgtaagcaggctgaatgctgatgtggatgagagagaggggggggggaggagagagagagatagcttacagccatcagccggccgtattattagccctgctctcagagaatgaatcagcctaagatcatgtctctccctagcatgtattgaaactgaagggatctgatgctcctctgggattagggtgtatgtcaactcaactcaactcaatgggtctttgggattagggtgtatgtcaactcaactcaactcaattggactatggacggcgggcctgaaagagtcatttactctggtttcatgcctccatctctgtagtctgtagtatactagcctgcgtgtgtttcattttctgcgtgttttctattgtgaagatattctgacaccagaatatgatggcgtgaaataatcattcatttgtttgcaactgttggtggcacaaaatgcaataggtgttaccatcatcgttgtataattgcccctcaggcatgctactgcaatgaaccaatgatcattgaatatttcatgttgatgcaatttgaggtc

SEQ ID NO: 772 - DNA, 1665 bp, Sorghum bicolor
atgcggacactgtttatcagcaaagggtcaggtttttcatctcgcagcgttctgacaggtgacccatacattgggttaggtgtagtagggcttccttctgaagtagctaagcggatgacctttgaagaacaggtcacggacataaacattaacagactgcaggaggtggtagacaagggactctgcttgacctacagagatggtcaagcaacttatgctataactgttggatcaaaagggcacacaacacttaaagttggtcaaactatcagtaggagaattgttgatggggatgttgtgttcctcaataggccgcccagcacacataagcattctcttcaagctttctacgcatatgtgcatgatgatcatacagtaaaaatcaatcctctcatgtgcggccccttttctgctgacttcgatggtgattgtgtgcatatatattatccgcaatcgcttgctgcaaaagctgaagccttggagctttttagtgttgaaagacaactaatcagttcccacagtgggaaggttaacctccagctaggtaacgactgtttggtagctatgaaggctatgtctgacagaacagtgttacacaaggaactagcaaaccagctggcaatgtttgtgccattctcacttctggcccctgctgtaatgaagccaattccgtcttggacaatcacacagatagtgcaaggtgcattaccagctaaattgacttgccaaggggacacacacttggttagggacagcacaatcataaagctggatcttgacaaagaatctgttcaggactcattcccagatttggtgtcctccatccttcgtgagaagggtccaagagaggctctgcaatttctgaatgtgctggagccattgttgatggagtttttagttctcggcggtttgagtataagtctgcgggattttaatgttcccaaggctctattggaggaagcacaaaagaacattcagaatcagtcccttgttcttgagcagtcaaggtgttctacgagtcaattcgtagaattacgagtcgaaaacaatttaaaaagtgtcaaacagcagatttcagattatgttgggaaattctctggccttgggttgcttattgatccaaaaaaggaagcctcaatggcaaaagtagtacaacaagttggttttgttggcttgcaactgtaccgtgaaggtaaattgtactcgaggcgcttggtagaggactgcttttcaagctttgtgaataaacactcagccattggagatgagtattcaccagaagcttttggtctggtgcaaagttcatattttcatggtctgaatccgtatgaagaactggtgcatgctatatgtactagagaaactatgatccgctcctctagagggctgtcagaacctggaactttgtttaagaatttaatggccatcttgagggatgtagttatatgttatgatggaactgtgagaaacatttgtagcaattccatcattcaacttaagtatggggaagatgatgaagctgattcttcaagtgctgtacctcctggtgaacctgtgggtgtcttagctgccacagctatctcaaaccctgcatacaaggccgtcttggattcctcccaaagtaacaatgcttcttgggagtcaatgaaggtagtaaagttataa

SEQ ID NO: 773 - DNA, 588 bp, Sorghum bicolor
gcacctttccggtcaataacagttagagatacagttggggatctcccacccgtggaaaatggcgccagcaagccaacaatacagtatgggagtgaaccagtgtcatggttccagaagaagatcagagacagcaccgtgttgctgaatgaccacatatccaaggagatgaacgagctgaatctcatcaggtgcaagcacattccaaagcgacctggctgcgactggcatgagctaccggatgagaaggtgaagctgtcaactgggcaaatggtggaccttataccctggtgcctgcccaacactgccaaaagacacaatcaatggaaagggctctatgggaggctggactgggagggcaacttccccacatccgtgaccgatccccagcctatgggcaaggtcggcatgtgcttccaccctgagcaggacaggatcgtcactgttcgtgagtgtgccaggtctcagggcttccctgacagctaccgtttcgcgggcagcatccagtgcaagcacaggcagatcggcaatgccgtgccgcctccgcttgcctacgcgctcgggaggaagctcaaggaagccatcgacggc

SEQ ID NO: 774 - DNA, 4359 bp, Sorghum bicolor
atgctgaccaatgaattttcaggaacaagaagatgcagagcaaagccacaaaagaaggaaaaggaatccacagaaaacagcaaactggagaatggatctcaggatgcaacagaagaggtgcatcatggagtcgaaaaaggtgatggacatgttacccgcaagagaccaaggagagcagcagcgtgttctgatttcaaagagaaatccatacgcttatccgaaaaaaaatctgttgtcatggtcaagaagaatcggatggaggaagaagaaatagatgctgtgagtctgacaaaacttggaccagaagatccaccaccttgccggaagttgattgatttcatcttgcatgatgcagaagggaacccacagccctttgaaatgtcagaaattgatgacttcttcataacagctcttatcatgcccatggatgatgatcttgaaaaagagcgtgaaagaggagtacgatgtgaaggatttgggcgaattgaggactggaatatttctggttatgatgaagtgtgtgaagggacagcggaagaagaagatgatgatgcaaaattagctagattacttcaacaagaagaagaatggaaaatgatgaagaaacagaggggtaggcgtggaacaccatcccagaaaaatgtctatataaaaataagtgaagctgagattgccaatgactatccccttcctgcatactataagccatttagccaagaaatggatgaatacatatttgatagcgatgacagtatattttctgatgatgtgccagtgaggatactcaataactggactctgtacaatgcagattccaggcttatatctttggaattgatccctatgaaatcaggagcagaaaatgatgtggttgtctttggatctggtttcatgagagatgatgatggcagttgctgttctacagctgagtctgtgaaatcgtcgtcttcctccagcaaagctgaccaacaggatgctggagtccctatttatttgagcccaatcaaagaatggcttatagagtttggtggatcaatgatttgtataaccattcggactgatgtggcctggtacaagctacgccaaccaacaaaacaatatgctccatggtgtgagcctgtactgaaaacagcaaggcttgctgttagcatcatcaccctgttaaaagagcagagtcgtgcctcaaaactttcttttgctgatgtcatcaaaaaagtagctgaatttgacaaagggaatcctgcatttatatcttctaacatcgcacttgttgagaggtatattgtggtgcatggacagataatattgcagcagtttgcagattttccagatgagactatccgccggagtgcatttgttagtggtcttttattgaagatggaacagaggaggcatacaaagctagttatgaagaagaaaactcaagtaatgaggggagagaatctgaatccaagtgcagcaatgggtccggcatcgaggagaaaagcgatgcgtgcaacaacaaccaggttgatcaacagaatctggagtgattactatgcacatcatttccctgaagattccaaggagggagatggaaatgaagcaaaagaagttgatgatgaacaagaagaaaatgaagatgaggatgctgaagatgaagggcagattgaagaggataagatctcaaagactccaccatcaacacggtcccgaaagttgctatcacaaacttgtaaggaaataagatgggaaggtgaaacatctgggaaaacatcgtctggagaaactctttacaaatgtgcttatgttagagaactcagaatacctgttggtggaacagtggtgctagaagatgattcaggagacacagtcatgtgttttgttgagtacatgtttcagaaaagtggtggtgcaaaaatggttcacgggaggattctgcaaaaaggttcacataccattcttgacaatgctgcaaatgagagggaggttttcttaactaatgattgtttagaattcaaattagatgacatcaaggaattggtaagtgttgatatccaatcgagaccttggggtcacaagtatagaaaagagaattctgaaactgataaagttgagcaggcgaaagcagaagagagaaagaaaaagggcctgcccatggtatatttctgcaaaagcttatactggcctgagaagggtgccttctttgccctcccccgtgataaaatgggtcttggtagtggtgtatgtagttcttgtgaacatatagagccagattctgatgaattgaaagtactttcgaagaccagctttgtctacagaaaggttacatataatgtcaatgactttttatacataaggcctgattttttctctgaagatgaggatcgtgcaaccttcaaggctggccgaaatgtgggtctaaagccctatgcagtttgtcaaatactggccatccctgaaggagctggatctaaaaaactcaatccagcatcagcaaatataagtgctagaagattttatagaccagatgacatttcgacagccaaagcctatgcatctgatatcagagaggtctactatagtgaagatgtaattgatgtgcctgtggatatgatagagggaaaatgtgaggttagaaagaagaatgatcttgcaagttcagaccttccagtgatgtttgaacatgtatttttctgtgaacttatatatgaccgtgccagtggagctctcaagcagttgcctccaaatgttaggtttatgtccatggtgcaaaaggcaacaattgcttcgaaaaagaacaaaggaaagcagatctgtgagactgatcaaatagattcaggtaaatggttggatgtgccaaaagagaaccgtctagctacgcttgacatttttgctggctgtggaggtttatcagaaggtctgcagcaagctggtgtatcttttacaaaatgggcaattgaatatgaagagcctgctggtgaagcatttagcaaaaatcatccagaggctgtggtctttgtagataactgcaatgttattctaaaggcaattatggataaatgtggggatactgatgactgcatttcaacttctgaagctgctgaacaagcagcaaaacttcctgaactgaacattaataaccttccagtccctggtgaagtagaattcataaatggtggtcctccgtgtcagggattctctgggatgaatagattcaaccaaagcccttggagtaaagttcagtgtgagatgattctagcattcctctcattcgcagagtatttccgtcccagattctttcttttagaaaatgttcggaactttgtttcattcaacaaagggcagaccttccgattagcagttgcatctcttctggagatgggataccaggtccggtttggaattctagaagcaggggcttttggtgttgctcagtccaggaaaagggcattcatttgggctgctgcacctggagagatgcttcctgattggccagagccgatgcatgtgtttgctagccctgagctgaagataacactgcctgatggccaatactatgcagctgccagaagcactgctggtggagcgcctttccgggcgattactgttagagatacaattggggatctgcctaaagtggaaaatggtgccagcaaactcacacttgagtacggaggtgagcccgtgtcctggttccagaagaagataagagggaatatgatggtactgaatgatcacatatccaaggagatgaatgagctgaacctcataaggtgccaacacattccgaaacgaccaggttgtgactggcatgacctaccagacgagaaggtgaagctgtctaatgggcagatggctgacctgataccttggtgcctgcccaacacagccaagagacataatcagtggaaagggctgtacgggaggctggactgggaaggcaacttccccacatctgtcacagacccccagccaatgggcaaggttggcatgtgcttccatcctgaccaggacaggatcattacggtccgagaatgcgctcggtctcagggctttcctgacagctatgagtttgcgggcaacatccagaacaagcaccggcagattggcaatgctgtgcccccgcctcttgcctatgcgctcgggaggaagctgaaggaagctgttgacaacaagcgtcaggaagctggcgtgggcgtccctgcaccatgagaagcttcccttccatggctcatgaagccaaacgctgaggtcgtctttagaaacagcgaagggcagagtagcctgtgatgtcatgtctaaactgcagtaacttagttaatcatggtttcagtcttatggaccccctgagtgtatatgctagcgaagtgttgattg

SEQ ID NO: 775 - DNA, 2671 bp, Sorghum bicolor
ccccagtcccccacgcccaaaaccccaagtgcctttctcgccgcttccgactccgccatgccaccatagatccagctagggcggcgtcgttgcgttcaatcctgtgcgagagaacgcgaatcgccgccggcttgatattggccagggctttctccgcccaattgcatcaggtctcgccgtcatttgcagcgaccgtgctctaattggggcgaaaaggaatcttatctgctgaatccccgagctccggcgatggattttgacatggacgactacatagacccctacgaggaggctgaggctgaggctgccgcgggcgaggacgacgactccgacgaccccgacgaggacgactcggatgcggagagcgactacgaggagaagtcgttcggcctcctcaagtccggcaagcaccgggtgcgcaacccggacggcaccttccgctgccccttctgccccggcaagaagaagcaggggtacaagatcaaggacctcctccagcacgccgacggtatcggcgtctccagcaagcaccgccgccacggccgcgagcgcgccaaccaccgcgccttcgcgcgctttgtccgcaccgatccggacttcgcggaagacctcgtcggtatcactggcattcaaggtgccattacaaccacccctgctgataagaatggtggcagtgccaatggcgacgggaaggccaaggctaatggagatactgctggatccagttccgtggcggcgaaagtgggtccgccacaggaggttgagaggtttgcttggccgtgggcttgtgtgcttgcagccggggcagggttcaatcctgaggagtttgctgatagagtagcggtgtttagtttggttgaggttgtgcctttgtttgttgatgagatggaagtcacagaaacctttgcaatcgtgaggtttaccaatgattggagtggattcaatgacgcgcttacgcttgagaaccattttggtgtcaataagctagggaagaaggagtttgagacgagagacagtggtctaggttccgtggagggagatggcggcaaaggtgaagtcaaggtttatgggtgggttgcccgagccgaggactatgatgcaacgagtgtggtaggaagattcttgagaaagcacaccgtcctgaaaacaatagatgaggtttccaagactgaattagagaaatcaggggagatggtggcaatactggcatcccagatcgaggaaaagaaccgatacttgcaggatttggagacaaagaagaatgcgacagaactctccatctcaaggcttgaggacgacaacaggaaactgcatgaggcatataatgaagaaatgcgcaatcttcatcgcagggctcgtgaaaatgctatgcggattttccaagagaatgaaaacttgaggattgacttagaaaataagaggagagaactgaacttacgagctaaggagcttgaaaaaatgtcagctgagaatgctaatgacaggaagacactcgatgatgagaagcagaaggcaaaatatgataatagtgaacttgagttagctagcatagagcagcagagggctgatgcagatgttctgaagctattggctgaccaggagagggaaaaggaagaggtacttgctagaatgcttcagctagaaaaggagctgcatgagaagcagcagcttgagcttgaagtagaacggttgaatggtacactccaggtgatgaaacatttagagggagatgatgacgggggagatatccatgagaagatggagaagctgagtgtaagatttgagcatgaaaagaagcgcctggaggatttgagtggagatctcgtgagaaaagagcgtgaaagtaatgatgagctacaagtggcccgaaaagaactgataaagggtttggaggaagagctggatgggcagacagctattgggatcaaaaggatgggggaactcgatgaaaagcctttcctaaatgcatgtaagagaaaatatggaaagggtgaataccagataaaagcagcagagctagtcacaaattggcaggaggaactaaagaagccatcctggcatccttttaagatggttgaggttaacggagaaaataaggaaattctggttgacgatgatgcaaaactgaagcacctatggattgagtacggcgacgatgtgtgtaatgcggtgaagactgcactgatggagataaacgagtataacccaagtgggaggtatgtagtgcccgagctctggaacttcaggaaaggtagaaaggcaacgatgaaggaggtgctcaagtacctgttcagtcagatggacacgacgaccaagcgcaggaggggctgaggaggcgccccgaggccgagaagccaataagtagcgcctttacgctgctctgtcagtcgtgtgctgctcgatcttctagttagtggtagtctggcataataagtgttcgtaatcaaggcttaggtatgcatcatgttcatgctgttgccgggcaggcgtcctaaaaacctatgtgatcgttgaactgactactgagtaatctttcgtgctgctattattgttcgggtgtaaatagtttggtgcctgctccttcgtggctttctcgtgtgtgtaatcatttgaccgttcatttgtaaatcattgaatcatcatgctgccttataatcagtaggggctttct

SEQ ID NO: 776 - DNA, 1731 bp, Sorghum bicolor
atggcggacagggtcggtggcagcgacgacggagacaagtccgagtggaatagtgacggtgaggtggcgaggagcctcgatggcgctggctcgccaattgcgccctcgaggaacaagttaaaagatgctcctggcccgtccctgctggtcaatggagcagggccatctgcctctttggtggaggactttgtagggatgggtcttattaaggggaatggggatggtggtgcagagtcattactagagctccttctggcatacaaggcgataggcaatgacccttcattggataaatcctctgcttctgtttgtggcccccggaccatttgtgatgacaaagacattcttgcgaattgggatgcgcatgatgctagtacgagcagtgacagggatcatgcatctgatgattctggtgatgaggatttcctacagggcttgtcacagaaggatgaaaaaattgagtccttagtgagaatgggctttcctaaagatgaagcagaaatggccattgtcagatgtgggcaggatgcacctatgtctgttttgattgatttaatctatagttcagaagcttcagaagatggttactatggcaatttctctggccatgaggatgattcttttggaggaagaaaggaaaagagaaagagatctgaagatgcagaacaaggcagtagccatgatgagccgatgcctctcccaaacccaatggttgggtttaacctgccaaatgtgagcttaagatcagtggacagatctctaccatcaaaggctattgggccacctttcttctactatgagaatgtagccattgctccaaagggtgtctggacgacaatatcacagttcttatatgacatccaacctgagtttgtggattctaggttcttatgtgctgctgccaggaaaagaggttacgtacataacttgccaattgagaacaggtcacctctccttcccttacccccaaagacaatatttgaggccttcccccatactaaaaagtggtggccctcatgggaccctagaaaacagttcaactgcctcctgaccagtatggctaaacctaagttaacggaacagattcaccatgctcttgcaaaatgtaaagatccaccacctcgacgtgttcagaagtatgtcttggaaacctgcaggacggcgaacttggtatgggttggtctgaacaaggttgctcatctagagcctgatgagatggagttcctgcttggtttccccaaagaccacaccaggggaatcggcaggcctgagaggttcaagtctttgggcaattcattccatgtcgacaccgtcgcataccatctctcagcacttcgggacatgtttccacatggcatgaatgtcctttccttgttctctggcattggaggagcagaggtagctctccacaggctcgacattcgcatgaagacagtcgtttcggtggagatatctgagacgaacaggttcgtcttgaggacttggtggaatcagacccaaacaggcactttgatagagatcaccgatgttcagagcctgactaccgagaggctcgagtcatgcatcaggaggattggtggttttgacctggtgattgggggcagcccctgtaacaatcttgctgggcgcaatcgattccaccgtgatggcttggagggagagcagtcgtcgctcttctaccactattacaggatcttggacacggtgaagtccatcatgggcagaatgtag

SEQ ID NO: 777 - DNA, 2363 bp, Sorghum bicolor
atgccagtggcgtaccaccagcgacctgcccattgctggtgctgtttggcgggcgcggcgcgtgagtttcttgttgagacttgcttggagattcgccgtctccccctctcgtctaaaagcgggcaaagcagagacggtggaggcaggcagagccgccctgtcgccggcgcggcctcctgctcctcctcctcctctgccaccgcctcccaactcccagcgcgcaggggccgacggcgacgggaggggagaagcggcagaggtagtccgaggaggggcggggccgacggcgacgggaggggagaagcggcagaggtagtccgagggggggcggagagaggctgcgccgtcccactccgtccggtgcctcagcccccggagccccttcgcgaaggttcgggaatggcgcactgggttagcgacggtgatggcagtgacagcttcgaatgggatagtgatggcaatggggaggaggcagggagcttcaacactgctggtgccagttcatcagcaatggcatcaacgaacactgacgctccaggcccatcgagacgggtaagccaggttgctaatggcaatgggaaggctgggccatctgcctctttggttcagaggtatatagacatgggtttcgcagaagagattgttgtgaaggccataaaggacaatggcgataatggagcagatgcattagttgagctgcttcttacttaccaggaactaggcaatgacctcaacgtggataacggctttgcttctggttgtgtcccccaaactgttgacgatagtggtgatgatgactttctagaaaactgggatgatttagatgctggtgggagaagcaccagagttgctaattctgttgatgattctggagacgaggatttcttacatgagatgtcacagaaggacaacaaaattgattccttagttaaaatggggtttcctgaagacgaggctgcactggctattactagatgcgggcaggatgcgtctatttctgttctggcggattctatctatgcttcacagaccgcaggagatggttattgtggcaatttgtctgactatgaggatggagggagaaacaaaggaaggttcatggatgggaacaacaaaaagagaaagagatatggaagtcaagcactgggaagtagaggcccattagatggtagcgctgatgaacccatgctgctcccaaatccaatggttggatttagcttgccagatcagtggccaagaccagtgaacagagatctacctgcactagctatgggtccaccatacttctactatgagaatgttgctcttgctccaaaaggtgtctggactatcatatcaagattcttgtatgatattcagccggagtttgtggactcgaagtacttctgtgctgctgccaggaaaagaggttatatacacaatttgccacttgagaacaggtcacctctcctccctaaacctccaaggacaataactgtagcatttcctcataccaaaaggtggtggccatcatgggacccaagacaacagttcaattgcctccagacttgtgtgtctagtgcaaaactgttagagaagattcgcgtaacccttacaaacagttcagatccacctcctccaagagttcagaagctggtgttggaggagtgtaggaaatggaatcttgcttgggttggcttaaacaaggttgctcctctagagcctgatgagatggagtttctactcggctttccgaaggatcacaccagaggtatctgcaggacagagaggtttcgatctctaggaaattcatttcaagttgatactgttgcttaccatctctcagtcctcaaggatatgtacccagaaggcatgaatgtactatctttattctctggtattggaggagcagaggtggctctccacaggcttggtatacgcatgaagacagttatttcagtagagaagtctgaggtcaataggacaattctgaggagttggtgggatcagacgcagaccggtactttgattgagatcaatgatgtgcagacactgacatctgagaggattgaggcatatattagaagatttggcggctttgatcttgtgattggtggaagtccctgtaacaatcttgctgggagcaaccgtcaccacagaaatggtttggagggcgaacattcttcattgttctttcagtatgttaggatcttagagtccgtcaagtccatccagcgtttatagtctttaggatcttcattgttttggttctggaattgtagcatctttcgttgtgatcaaacttgtgaataatttgaacgtcgactggtgtaattctcatgtcactctaatttaggctacttttaattttatcccctttggtg

SEQ ID NO: 778 - DNA, 2062 bp, Sorghum bicolor
gccggggccgtggaaaacgagagggatcgagggaggggtatccgtcggagcccctttgccaaggttccggaatggcgcactgtgttggcgacagtgatggtagtgacaacttcgaatgggatagtgacggcgatggggaggaggcagcgagcttcaacgctgctggtgccagttcatcagcaatggcatcaacgaacgctgatgctccaggcccatctacacgggttgctaatggcaatgggaaggctgggccatctgcctctttggttcataagtatatggacatgggtttcccagaagagattgttctgaaggccatgaaggacaatggggataatggagcagattcattagttgagcttcttcttacttaccaggaactaggcaatgacctcaaagtggataatggctttgcttctggttgtgtcccccaaaatgttgacgatagtgatgatgatgacattctagaaaactgggatgatgaggatgctggtggtagaagcaccggggttgctaactcggttgatgattctggagatgaggatttcttacatgagatgtcacagacggacgagaaagtttattccttagttaaaatggggtttcctgaagacgaggctgcactggctgttactagatgcgggcaggatgcatctatttcggttctggtggattcaatatatgcttcacagactgcaggagatgtttactgtggcaatttgtctgactatgaggataattcctacggagggagaaacaaaggaaggttcatggatgcgaacaaaaaaaggagaaagagatatgaaggtcaagcacacggaagtagaggcccattggatggtagctctgatgaacccatgcctctcccacatccaatggttggatttagtttgccacaccagtgcacaaggccagtggacagatcactgccttcacaagctatgggtccaccatacttctactatgagaacgttgctcttgctccaaaaggtgtttggactaccatatcaagattcttgtatgatattcagccagagtttgtggactcgaagtacttctgtgctgctgccaggaaaagaggttatatacacaatctgccacttgagaacaggtcacctctcctccccatacctccaaagaaaatatcagaagcatttcctcataccaagaggtggtggccatcatgggacccaagacgacagttcaattgcctccagacttgtgtgtctagtgcaaaactgttagagaggattcgtgtagctcttacaaacagttcagatccacctcctccaagagttcagaagtttgtgttggaggagtgtaggaaatggaatctcgcttgggttggcttaaacaaggttgctcctctagagcctgatgagatggagtttctactcggttttccgaaggatcacaccagaggtatcagcaggagagagaggtaccgatctctaggaaattcatttcaagttgatactgttgcttaccatctctcggtcctcaaggatatgtacccacaaggcatgaatgtactgtctttattctctggtattggaggagcagaggtggctctccacaggcttggtatacgcatgaaaacagttatttcagtagagaagtctgaggtcaataggacgattctgaagagttggtgggatcagacgcagactggtcttttaattgagatttgtgatgtgcagacattgacatctgagaggatcgaggcatatgttagaagaattggtggctttgatcttgtgattggtggaagtccctgtaacaatcttactgggagcaaccgttaccacagagatggtttggagggcgagcattcttcgttattctaccactatgttaggatcttagactctgtcaagtccatcatggagcgtttgtagtttttagaatctttattattttggttctagaattgtagcatcttttcttgtgatcaaactggtgaatgatccgaaggttgactggtgtagttctcatgccactctaatttaggctacttttaatttaatctcgtttggtgatcaatgcaaattgatgttggtgc

SEQ ID NO: 779 - DNA, 4761 bp, Sorghum bicolor
atggcggccgacccgccgcccccacctcctccggcgcagctcccgcctcctcgccgcccgcacaagcagcttcagccgcgggggtaccaggtggaggtgttcgccgcggcgctgcgcgggaacaccatcgcggtgctagacacaggctccgggaagaccatggtcgccatcatgctcgcgcgggagcacgtcctccgtgcgcgcgctggggagacgccacgccggatcgtggtgttcctcgcgcccactgtacatctcgtccaccagcaattcgaggtgattcgggagtacacagacctcgacgcggtggagtgccatggggcatcgggggttggcgactggaacgccaagcgctggaaggaagcaattggcagtaaggagattgttgttatgacaccacagatattattggacgctctcaggcatgcttttctaacaatgtgtgtgatgagcttgctaatatttgatgaatgccatcgtgcttgtgggaaccatccatactcaagaataatgaaggagttttacattgattctgagtggaggccagctatatttggaatgacggcatctccagtttctaaaaggggggcttctactatagaagattgtgaagcacagattgctcaacttgagctagtattgaatgccaaggtatatattgttgaagataggaatgaacttgagagcttttcaactggtgcgaaaattgtgaataaatactatgatccttacttatttgatttggatgatctggaatcaaagttacagatgctgttcgaggaggtggtgaaaatatataatgaaagcattaataccgtaggtgattctgaagattgtctattttctaaagcaagcctcaacttacaggtgtcctatttcaaagaagctttatttttgattgaagaatttttgccacagggttatggggagctgatgaaatcagaatctggttctgcggaactaactaagaggggatatgtttcttctaaagtgcagacactgatcaacattttcaaatcatttggctcgtcagaggaagtgctttgcatgatttttgtagaaagaattatgacagccaaagctgttgaaaggtttatgagaggaaatgtgaacttctctcgtttttcaatttcatacttgactggagggagtacatcaaaagattctttgagcccagcagtacagagatttactttggatttgttccgagctgggaaggtgaatttgctttttacaacagatgtcactgaagagggtattgatgtacctaactgttcctgtgtgatacgctttgacttacccagaactgtttgtagctatgtccagtctcgtgggcgtgccagaagaagcagttcaagttatgttcttatgattgaaaggggtaacttggtgcagcaggaacacatatttcgtataatacgaactgaatactatgttaaaaccttcgcactgcataaacagccaaatactccatcacttgatttgcctctccaagagaagtacatgtaccatgttgaatcaacaggagcaactatcactgcagaatgctgtgtcaatctaatttataaatattgtgagaagcttcctaaagataggtattacttgccaaagccttgctttgaggtgggtctcaaagatgggtcatatcaatgtgccttgacaatgccccccaatgctgcatttcgaagtatagttggtcctccaagcagtacatgtaatttagccaagcagcttgtatgcctcgaggcatgcaagaaactgcacgagctgggagaactcgatgatcatctagtacccttgactgaagagcctatggatatcgatacagacacaacagataaaaaatgtgtttctggaccaggaacaactaaacgaaaggagcttcatggaataataaatgttcatggtctatctggaaactggatccatgaaagtgaaactgtcattctgaattcttacacatttgattttcgttgtgatcaagaaggtgaaacttttgctgggttcgttctcttaatggaatcagtacttgatgatgacgtggcacattcagaaatagatctcttccttatacctaataaaatggtgtacaccgccataactccttgtggaaaaattcaactgaacaaagagcagctgcgtaaaggaaaattattccaagaattcttcttcaatggtatatttggtagattatttcatggttcccgaacgagtggactgcaaagggaatttattttcagaaaaggtcatgaaatacaatggggctcagacaacatgtacttacttttgcctttgaggaactcttcacatatacagcatgatctgaacatatactgggaagccgttgagtcttgctctggtgcagtggagcagttgagaaatttgtatctagaagatggaaatcttaaccatgaaaacttatgttcacataaaagaagcaacaagggagaagacatcattcatctggccaataaatctcttcatttttccacagtcaaagattcagttgtgctgtctcttcatactgggaggatctattctgtccttgacttgattttagatacaactgcagacgactcattcgatgagatgtataatgggaaagcttcaccattttcttcattcgtggactattaccatcaaaagtatggtattgttattcaacatccagggcaacctttgttgctgttaaagcaaagtcacaatgcacacaatttacttttttcaaaaatgaaataccaagatggttcaactggcaatcctctgctcgtggaaaaagagcaaattcatgcccgagtcccacctgaactactcatccacattgatgtcacaactgatattctcaaatcattttacttgctcccttctgtaatgcatcgggttcagtctttaatgttagccagccagcttcgcagagacattagttacactcaacgcataccaagttctctgattttggaagctataacaactttaaggtgctgcgagaccttttctctggagcggttggagttattaggagactcagtactgaaatatgtaataggatgtgacctgttcctaagatatccaatgaaacatgaaggccatctctctgatatgagatccaaggcggtatgcaatgcgacactgcataaacatggaatatgccgatccctgcagggttatatacgtgatactgcattcgaccctcgtcgttgggttgctcctggacagatatcattgcgcccttttccttgtaactgtggaatcgaaactgcatttgttccttttactggagaatatatcagtgatgatccatcttttattgtgggaaaaccatgtgacagaggccacagatggatgtgctcaaaaacagtatctgattgtgttgaagcactagttggagcatattatgttggtggtggcatcactgctgcaatttgggttatgaggtggtttggtattgatgtcagatgtgatatggaactagtgcagaaagcaaaatataattctaatgcatctcaattgtgctatttatcaaaattaaaagtttttgaggaactggaagcaaaactgaagtacaacttctcggtgaaaggccttctgcttgaagccgtatcacatccatctctacaggaattaggagttgactattgttaccagcggctggaatttcttggtgattctgtgctggatctattaatcacacaacatctctatgctacccacactgatgttgatcctggagaattaacagacttgcgttcagctttggttagtaatgagaattttgcacaagcagttgtaagaaacaatattcatagtcatctacagcatggatctggaatacttttggagcaagtaacagaatatgtcaggtccagtttggagtaccatggtaaagagaatgaattcgttcaacaagctacatttaaagcacctaaggttcttggagacatcatggaaagtattactggtgcaatatttatagatgtaaattttaacgttgatctggtttggaagattgttgaaccgttactttctccaatgattacccctgataagcttgcattgccaccttatcgggagttgctggagttatgtagtcaccttggttgcttcataaagtcaaaatgtactagtaaaggagaagaattaattatagagatgacggtgcagctgcgagatgaactgctgatagcacaaggacatgacagaaataggaaaagtgcaaaggcaaaggcagcagcccgaattttggtcgacctgaagaaacggggtctttctcttaaacaatgtttctctaaggctaagcaattggatattgtctcttcagaactgcaatcagaattgataagtttggaatcacgatatgattgtcctgacgtgaatggcagtcttagcctagaaggtctttcctcggtgagagcagcagttgttcttcctctcaaaatggataaaggtggacctcggactgcactttttaggctatgcaagagattgcagtggccaattccagaatttgaatttgtggaacaaaggttcaggactcctattgttctggatggggttacaaccacaaacttcaatagcttcgtttcaactattaccttgcacatacctgatgtgactgtcattacacttcaaggtgagcgccggactgacaagaagagttctcaggattcagcgtctctggtaatgcttcagaaacttgaagaactcaaggtctgcatatgcaagcagacacagcaaagcaacatggataataataccagttaa

SEQ ID NO: 780 - DNA, 4953 bp, Sorghum bicolor
atgaatcttttgaagaggccatccaactcatcgcctccagaagacgaaacagacaagcataaacggcagaagagggaatgccaggatttcacccccagaaggtaccagcttgatgtctatgaggttgctatgaggcagaacacaattgcgatgcttgacacgggagctgggaagacaatgattgctgtcatgctcatcaagcattttgggaagatcagcaaagcaaataatgatcgaaagctcatcatattccttgcaccaacagttcaactcgtcacacagcaatgcgaggttattaagagctacactgattttgaggtggagcattatcatggtgcaaagggtgttgatcaatggaaggctcatagctggcaacaacaattcttaaaatatcaggttatggtcatgacaccacaggtgttgctagatgctttacgccaagctttcttgatcctggacatggttagtctcatgatatttgatgaatgccatcacgcaactggtaaccacccatatactaggataatgaaggagttctatcacggatcagagcataaaccaaatgtgttcggtatgacagcctctcctatcataagaaaaggggtctcatctgatttggattgcgaaaatcagctatctgagctggaaaatattttagattccaagatacacgctgtggtggatagagaagagatagaactttgtgttccttccgcaaaagaagtgaacagatactatgagccgagaactgtttcttttgaagatttaagtgaagaactggaaattttgtgttccaagtatgatgggctgatcgtacaattgcataacagatcgaccaatcagtacaaagatgctgatgaaataacaaaagaatcacggagacgtctctcaaaatctttagcaaagatttgctattgccttgaagatgccggtcttctttgtgctagtgaggccactaaaatctgcattgaaagagggcagagaaaaggttggctgaaggggggcagtgacaccactgatcagcaaagtgatccaaatggaccaatcctatttgcagaaatttcaatgcttcatatgaagttctttcaggaagtgttggatataattgacaaacgcctccaacaaggaattgatgcccttctgaactcagagagtggatgtgtggaagcagcaaagatgggctatatttcaccaaagctctatgagctcatgcgagtatttctttctttcagtgactctgataacgtccgatgccttatttttgtggaccgaaagattagtgctagagtcattgagcggacaatgaagaaaataggccgactctcctgtttcagagtctcttttctaactggagggagttcttcagtggatgcactcacccctaaaatgcaaaaggatacgctggattcattccgctctggaaaggtcaacttactgtttactacagatgttgcagaagagggtatacatattccagactgctcgtgtgtaataagatttgatttgccaaggactacccgcagctatgtgcaatcacgtggacgagcacgacagcgggactctcagtacatactaatgattgaaaaggggaatgtgaaacaaagtgatttaatatctaggattatgagaagtaagacctcgatgactgagattgcttcaaaccgagagcctgaggattcacaccgcaatttcttccccattgaagaaataaatgaataccatataagcacaacaggagccaaaataactactgattctagcatcagtgttctcaaccagtactgtgacaagctcccgaaggacaagtactacaccccaagacccacgtttcagttcacccattatggtgatggttatgagtgtactgtaacactaccatccagtgccatgtttcaacttttggtaggtccaaaagcaagaaatatgcagaaagcaaagcagcttgtttgccttgatgcatgtaagaggctgcatcagctcggagcacttgatgaccatctttctccatcagttgaagagacgcctctggaaatttcaagcaagtctagtatctcaacatctggtacaaccaaacggaaagagctacatggtacaaccaaagttctttctatgtctggctcttggggttcagataaaagtgtgactaaacttcaaggctacaagttaaattttgtttgtgatcaagttgatcaaaaatactgtgactttgtccttctaattgatacaagtatagcaaaagaagctgctactttaaatattgatttatatttgcatgacaagatggtaaaagcttcggtttctccttgtggacctcttgagttggatgctcgacagatggaaaaaacaaaattgtttcaagcacttctatttaacggtttgtttggaaaactgtttattggatcaaaagcatcaaaaaccccaagggagttcattctcaagaaagatgatgcatttctttggaataaagaaaatatgtatttgctattacctgtggattctactcaggattctcataaaagtgtttgcatcaactggagtatagttgatatagcggctacaactgttggactcatgagaagcatttattcagatggcaaacataacctaaaggataaacttaatcatgaaaaaaatgacgaaaattttattcgtttggccaacaagtcatgcaaagctgatgatcttaaaaatatggtggttttagcaattcatactggaaagatatatactgttcttaaggtatctgatttatgtgctaatagtaaatttgatggtacatctgacaagaaagaagcaaaattccagacatttgcagaatattttgagaagaagtataatatatttctttgtcatcctttacaaccattgctagtgttgaaacccacccataatcctcacaatcttctttcctcaaagaatagagatgaaggtataattttgttttttgtaggcaatgttgtggaaaataaaaatagggcaaatagccttgttcacatgcctccagagttgctgattccccttgatttacctgttgatgttttgagagtattctatttgtttccatctctgatgcatcgtcttgaatcactaatgctagccagccaactaagaagtgaaattgcatacacagattctgatatatcgagcttcgtgattttggaagctattacaacacttagatgctgcgaggacttctcaatggagcgtttagagttattgggggactctgttcttaagtatgcagtgagtgcccatcttttcatgacatttcttaataagcatgaggggcagttatcgtccagaaggcaagaaactatatgtaatgccacactttatagacttggtactgaacgcagaatacagggttatatacgtgatgctgcatttgatcctcgtcgatggcttgctcctggacagctgtccagccgtccctgtccttgtgaatgcccagtaaaatctgaggttataactgaggatattcacagaattgatgacaaatctataattataggcaaggcgtgtgacaagggacacagatggatatgttctaaaaccatctctgattgtgttgaggctataattggggcctattatgtggaagggggattaaaagcagcttttgctgttctcaaatggttgcagattgagacacttgaggaagagcaaattatggaagccctatcaagtgcttcagtgcgaaattatcttccaaaagttgatgtagttgaatttcttgaagcaaaactaggctacacctttcaagtgaaaggtttgctaatagaggctctcacccacccatcacagcaagaatctggagcaacatactgctaccagcgcttggaattccttggtgatgcagtcttagatattttaataactcgccatttattccttagtcataaagacacagatgagggggagctgacagatttacggtctgcatcagtaaataatgagaattttgcacaagttgcggtaaagcacaatctccatcagtttctacaacattcttctgggttcctacaagaccaaattactgaatatgtgaatagtctggaaggttcatccatggacagaaccagccttttatccagtgggccatctagggggccaaaagttctaggtgatattgtagaaagtattgcaggtgctattcttattgacagcaaacttgatctggatttagtctggcgggttttcaaacctcttctttccccaattgtcacacctgagaatttggagttacccccattcagagaacttaatgagtggtgtgacaagaatgggtactttattggaattaaatgtgaaaatcgaggagacaaaacaacggctattcttagcttacaactcaaggacttgcttctggtgaggcaaggttgtgggaagaacaaaatagatgcaaaagcacatgcagcttccttattgctcagggatctagaggaaaaaggacttataattccaaagaatgcaagcagagtggaacaatttgaaaagaattctggtactagaaaccattgcaacaacttggttgatgttatggacacacaaaatgtagcaccacctaggcaaaaggaactaccggtgtcaagtaccgctcctggctctgttcttgataaaccattggttgtgaaggttaagttgagtaaaggaggacctcgtgtatcgttgtatgagtcgtgtaaaaagcttcagtggccaatgcctatgtttgaatttgtgaaagtcgagccaaaaaatatcagtgtgtgctcctcttccggtgattcttcacaaaaggttgcaccccaaggatatgcatttgcttcaacaataacattgcatataccgaacggcgatatcatcagcctcacaggagacggacgtgcggataagaagagctcacaggattctgctgcgctgctcatgctctatgagctgcagcggcgaggtagattccaagtccaagaagta

SEQ ID NO: 781 - DNA, 2742 bp, Sorghum bicolor
atggcaccgagctccccgtcccccgccgcgcccacgcgtgtctccggccggaagcgtgccgccaaggcagaggagatccaggaggaggaggttgtggtggcgtcctccgccaagcgcagccgcaaggcgccgtcttccggcaagaagcccaagccgacgcccaagcaggccaaaccggccaaggcggcgaggaagaagaagggggaggccgagaggaaggagcccgtggaggacgacgtgtgtgccgaggagcccgatgaggaggagctggccatgggcgaggaggaggcggaggcggcggccgatgagcaggccatgcaggaggaggtggccgcggtcgtggccgggtcgcccgggaagaagagggtggggagaaggagcgccgccgctggcggcgaccacgagccggagttcgtcggcaacgccgttcccgcggccgaggcgcgcagcaactggcctaagcgctacgagcgcagcactgccgcaaagaaaccggaggaggacgaagagctcaatgccaagtgccactaccggagcgccaaggtggacaacgtcgtctactgcctcggggatgacgtctatgtcaaggctggagaaaatgaggcagattacattggccgcattactgaattttttgaagggactgatcggtgtcactattttacttgccgttggttcttccgtgcagaggatacggttatcaattctttggtgtccattaatgttgatggccacaagcatgaccctagacgtgtttttctttctgaggaaaagaatgacaatgtgcttgattgcatcatctccaaggtcaagatagtccatgtggatccaaatatggatccaaaagccaaggctcagctgatagagcattgtgacctatactatgacatgtcgtactctgttgcatattctacatttgctaatatctcatcagaaaatgggcagtcaggtagtgaaaccgcttcgggtatttcttctgatgatgtggatctggaggcgccatctagtatgccagagaggacagcaacccttcttgatctgtattctggctgtgggggcatgtccactggtctttgcttgggtgcagctctttctggcttgaaacttgaaactcgatgggctgttgatcttaacagttttgcgtgccaaagtttgaagtacaatcatccccagactgaagtgcgaaatgagaaagccgatgagtttcttgctctcctcaaggaatgggcagtcctatgtgagaaatatgtccatcaagatgtggattcgaatttagcaggttcagaggatcaagaggatgaaggcagccctcttgacaaggacgaatttgttgtagagaagcttattggaatatgctatggtggtagtggaaggaaagatggcatctattttaaggtccagtgggaaggatatggtcctgaagaggatacatgggaaccgattgataacctgagtgactgcccgctgaaaattagagagtttgtacaagaagggcacagaagaagaattctcccgctgcctggtgatgttgatgtcatatgtggaggtccaccatgtcaaggtatcagtgggtttaatcggttcagaaaccgtgatgagccacttaaagatgagaaaaacaagcaaatggtgactttcatggatattgtggcttacttgaagcccaagtatgttctcatggaaaatgttgtagacatactcaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgatgttgtagtacgtggaaacaccccaaatgccttttcgcaatgtatggttgcatatgatgagaaacaaaaaccacacctgaagaaagctttgcttcttggtgatgcaatttcagatttaccaaaggttgaaaaccatcaacctaaagaggtaatggagtatggtggttcccccaagacggaattccagcgttacattcgacttagtcgtaaagacatgttggattggtcctttggtgaggaggctggtccagacaaaggcaagctcttggatcaccagcccttacggcttaataacgatgattatgagcgggttcaacaaattcctgtcaagaagggagccaacttccgtgacctaaagggtgtcaaggttggagcaaacaatattgttgagtgggatccagaaatcgagcgtgtgaaactttcatctgggaaaccactggttcctgactatgcgatgtcattcatcaagggtaaatcactcaagccatttggacgcctgtggtgggatgagacagttcctacagttgtaaccagagcagagcctcacaaccagattatattgcatccgactcaagcaagagtcctgactatccgggagaacgcaaggttgcagggcttccctgattactaccgattgtttggccccatcaaggagaagtatattcaagttggaaatgcagtagctgtccctgttgcccgggcactgggctactgtctggggcaagcctacctgggcgaatctgaggggagtcaccctctgtaccagctgcctccaagtttcaccgctttggggcgaactgcggtgcaggcgagggcctctcctgttggcactcctgtaggggaggttgttgagcagtaa

SEQ ID NO: 782 - DNA, 1464 bp, Sorghum bicolor
atggaatccagcggtaccaaggatggcctcaacaaggcgccaattcttcagagactcccaatgtcgaggcctcatgggtctggcacaaaagggaaccaaatacggcttcgtacaaaccacttcaaagtctcagttcacaggactgatgtcatcttctaccactacaatgtgagtgtgaagtatgaagatgataaaccagttgaatcgaaaggggtaagtagaacagtgatcgaaaagttgcaggaaatctatctggcaaatgtggactttgtttacgacggtgaaaacaacctatacacaatgtgtgcccttcagaatgtcgaggatgcgttcatggtagtagtggaggatggttcatctacaaagagtgctaggagtaggacccctggaggaaatggaagtccagaaggaagtgacacaaaaagaatgaagcggcccatgacttgtaagacgtacaaagtggaattgaaatcagtgggagaattttgtaaagaaaaaaaatcagtgggagaaatcccattgagtgccattgacaaagtcctgagaggtcaagaatctgatgattgtcaggaagcccttcgggttcttgacatcatacttaggcaaaagtcagcgaaacagggttgccttctagttaggcaatccttcttccatagcccttccgagcccattaagttgggtggtggtgttgtgcgatgtccaggatatcattccagctttcgacccactcaatctggactttcactcaacatcgatgtgtctacgactatgattgtggaacctgggcctgtcattaattttatactgtccaaccagtatatcaaggaccctagcagaattgactggggcaaagcaaagcatgcattgaggaatttgaggatcaaaaccactcacactaactctgaattcaagatttccagcctgagtgagaagtcttgctatgaacagaagttcctgttgaagcaaagaaacggcaatggacccgatgtcgtggaaataacggtctatgattactacttgaagcattgggatataagactgcaggattctgctatttttccctgcttggttgttgggaagcccaagcgtccgacatatctaccgatagagtccagaatctgtctacaattatcagctttgccatctagtgtcactgcaaaggcactgcaacgcattaactataattcggatgacatactgaagaagtgtggcatttcaatagctccagagtttgctcaagttgacggtagaatccttcaagcgccaaagctaaaagctggggatggtcaagatcttattgcacgtgatgggaggtggaacttcatgaacaggaagctctttgaggccaagggagtgcacacatgggctgcagttaattttacgacaaggtggaagcttcaggatcttgttcggaggctcattcactgtggtgacaacaagggcattgtaggtctatgtttctaa

SEQ ID NO: 783 - DNA, 1393 bp, Sorghum bicolor
atgggtattgtcactcaatgcattgctcccagtaataagatgaatgatcaatatttcaccaatgttcttctgaaaattaatgctaagcttggtggaatgaactctaaactggcattggaacatcgtcaaatgataccagttgtgactcaaataccaacattaattcttggcatggatgtttcgcatggttctccaggtcgagcagatataccatcaattgctgcggttgtgggatctagatgctggccattgatatcacggtatagagcatcagtgcgtacccagtctccaaaggtagagatgattgattctctatttaaaccactggatgatgggaaggatgatggcataatgagggaacttctactagacttctaccaaaccagccagcaaagaaagcctaagcagataatcatcttcagggatggtgttagcgagtctcagtttagccaagtactgaacgttgagcttaatcaaatcataaaggcatatcagagtatgggacagggggaccttccaaagttcacagtgatcattgctcaaaagaatcaccacacaaaactcttccaagctgattcaccagagaacgttccacctgggactgttgtagactccggcattgttcatccaagacagtatgatttctacatgtgcgctcatgctggaccaattggtacttcaaggccaacccattaccatgtgttgcttgatgagatcggcttctccgcagataatctccagaagctagttctttcactttcatatgtgtaccagaggagcaccactgctatttctgtggtggcacctatctgttatgcccacctcgcagcagctcagatgggccagttcatgaaattcgaagagtttgcagatacatcgtcagggagtgtcaattcatcatcgtcagcatcaataccagaactgccacggctgcatgctgatgtctgcagttccatgttcttctgttgaggtgattttagtttgaccgttgtggggtagggctacttctttctgaaggagaaccttatatgttggtacacagcaggttaactgttttgtgaagaaaccaagtaggttgttagttgtcgcaaatcatgtacgccagcatattttggagcagttttgggctcccccccaccccaccccaaaatgtaggtacagcttccagattttaggtagcctggacgtttgcatctgcaggtttttcgattggaatctagaagattttagggatattgagagagtagagccagacctttgaggtgaaggatacttggttaaatgatctttctgttaatccccaaaatgcgtgtgcattgggggggtataaaaatgagttaaaatttctgtatctcgcatggcatccaattgtactcgagtgtttgtgctgtac

SEQ ID NO: 784 - DNA, 3204 bp, Sorghum bicolor
atggcttaccgcggcggcggccgaggaggaggccgcggcggcgaccgcggggaccagcgcccgccgtacggccacggaggagccgggggatccggaggcggcggcggaggccggcccttcatctggccgccaccgccttccacgccgcgcccggtgatgccggcgccgccgccggggccatacccggtcccggtgccgatgggcggctaccgcgggcccatggtgatgccgcacccgggcgcgtacggggttccgatggccgtgtaccggccgtccgggcaagcggccgtgttcagggcgcccgcgccagcggcgccgcaggtctccttctcgcctgcgcctccggcagctccggtcaccatcagggcgccgccaccatcctcgaagacgacgtcgccggctgctccgtcgtctaccactccggcgcctccacgccagtccgcgcggcagagcgcctccacgccggcgtccgattcggctccggccgcctcctccgcgccgtctcccgcggcggccctggcgaaggaggtggagaagaagctgttcgtctccgagaccgcgctggcgccgcctgcgtcggcggcgcatgggacggctgctgcccgcgcggacgaggcgtcggacctcgacctggcgccggtctccaagaaggggctggcgcaccccgctcgcccgggcctcgccaccgtggggaagaaggtgatgatccgcgcgaaccacttcctcgtcaacgtcgccgacaacaacttgttccactatgatgaagtggactgcagatcagtgccgttccgtaaaaggctcttgccagaacatggaatcggaaaaaccattgggcagatgcgttggaaatcttgcatctgtttggtggctattaatcctgagtcaaagtcaagacaaaccaacagggaagttctgaatgagcttatcaagttgcatgggaagacagctctgggtggcaaactgcctgcctatgatggaaggaagagtctttatactgctggttcacttccttttgaatcagaggagtttgtggttacgctggttgatccagaaaagaaggacaaagaaagttatgtcacagtgtccagatcctttttctctactacttttggccaccgaggcgacattggcgaggggcttgagtgttggaggggttactaccaaagcctgcgcccgacacaaatggggctttcactgaatatagacatatcagcaacatccttttttaagcctgtgtcagttatcaaatttgtggaggagtacctgaacatgcgtgatacatctcggcctttgtcggacagagatcgtgtgaagataaagaaagcattacgtggagttcgcattgaaacaacccaccaacaggatcaaatcagaagatacaagataacaggggttacttccatccctatgagccagctgatatttcctgttgatgataaaggaacaagaaagactgttgtgcagtacttctgggacaaatacaactacagcttgaagcatggttcttggccttgtcttcaggctggcagtgattcacgacctgtatatttgcctatggaggtttgtaaaattctggaagggcagagatactctaagaagcttaatgacagacaagtgaccaacatacttagagcaacatgtaaacgtccccaggagagggagcagagcatacatgatatggttctgcataacaagtatgcagatgataggtttgctcaggagtttggcatcaaagttagcagtgatctagtgactgttccagcccgtgtgctgcctccacccctgttgaaatatcatgagtctggtagggagaaaacctgtgcgccaagtgttggacaatggaacatgatcaataagaaaatgatcaacggaggaactattgataactggacttgtttgaacttttcacgcatgcgacctgatgaggtacagaggttctgtatggatctgattcatatgtgcaatgcaactggaatggttgtcaatccacgtccatttgttgatgtcaagtctgcagctcccaaccatatagagaatgctttgagagatgtacacaggagagccacacaaatgcttgcccaacaaggagtgggaaatcagctgcagcttctgatcgtaattctgcctgatgttagtggttcttatggtaaaatcaaaagagtctgtgagactgacattggaattgtatctcagtgttgcttgccaaagcatgctagcagaccaaacaaacaatatttagaaaatgttgcactcaaaatcaatgtcaaggttggtgggcgcaacacagttcttgagcgagcctttgtacgcaatggcataccctttgtgtcagaagtcccaacaatcatctttggtgcagatgtcacacaccccccaccaggagaggactctgcctcatccattgctgctgtggtggcatcaatggactggccagaaatcaccaagtacagaggcttggtttctgctcaaccacaccgacaagagataatagaagatttgtttactgtcactaaggatctgcagaaggggcacagtgttaatggtggaatgatcagggagctactgattgctttccgcaggaagacaaacagaaggcctgagaggataatattctatcgggacggtgtaagtgaaggtcaattcagccatgtacttcttcatgaaatggatgccatcagaaaggcttgcgcttctttggaggagggatatctacctccagtcacatttgtggttgtccagaaaaggcatcacacaaggcttttccctgaggttcatggaaggcgtgatatgactgataaaagtggaaacattcttcccggaactgtggttgaccaacagatttgccatcctactgagtttgatttctacttgtgtagtcatgctggtattcagggaacaagtcggcccacccattaccatgtcctctatgatgagaatcattttactgctgatgcactgcagtcactgaccaacaatctatgctacacttatgctcgttgcacccgtgctgtatcagtggttccaccagcctactatgcccaccttgccgcattccgggcacgctactatgtggaaggagaaagctcagacggtggctcaacccctggcagcagcgggcagacagtagcccgggagggtcctgtggaggtgcgtcaacttccgaagatcaaggacaacgtgaaggacgttatgttctactgctga

SEQ ID NO: 785 - DNA, 3299 bp, Sorghum bicolor
atggcttcccgtgggcgcggtttcggcggagggcggcaaggccctggtggtgggcgcggcagcgagggcagggggcgcgggatcggtggcggcggaggttaccaacaaccctacggtcgcggcggtgatggaggcggtgaatccggaggccgaggcggcgtgggccgagggcgcggggtcggcggtcgcggcaacgggggaggccgcggacccggcggacgaggtggcgtcggctaccagcagccgccaccgccgccgctcgggaacgtagaggtcggaggccggggccgcggtggcgtggcggtagctgtaccagtaccagcccgccccgcggcgcctcgtcctcttgcgccggtcgtcgctgccccggcagttccagcagcggcctcgtcttctgcgccgccggcgcaagcgcctcgtgcccccgccggggcggctggaggcggagctgccttggcggcaggcatggggaggttggccgtggccgacaaccccgctcctcccgcgcctgctgcaggtagatccgaggcgcaaggtcctgcgcaccggcctccgcctccgcccctctcgagcaaggggatcactccgcctgcgcgccccgggttcggcacgttggggaggaagctcatcgttcgcgcaaaccacttcgctgtccaggttgccgacaacgacatctgccattatgacgttttaatcaatcctgaaccaaaggcaagaagaaccaacagggtgattctgtcagagcttctcaaggtgcatggtgcgacatccctcgcccataagatacctgcctatgatggaagcaagagcctatacaccgcaggcgagctgccattcaaatcaatggagtttgttgtcaagttggggcgccgagaaattgagtacaaggtgacaatccgatatgcggcacagccaaacctgtaccatcttcagcaattcctcaagggtcagcagagggacgccccatatgacacaattcaagcattggatgttgccctgagagagtctccttctctcaattatgtcactctttctcgatccttcttctccaagaagtttgataatggggtggacattggtggtgggctagagagctggagcggatattaccagagcttgcgcccaactcaaatgggcctctcattgaacattgatatatgctcgacttcattttaccaatctatccctgtggtaaaatttgttgatgattgtcttgggctgacaaaccctgcccaacctttttcggacagggatcgtttgaagcttaagaaagccctgcgtggagttcgtgttgagactacacaccagcaggggaaaaaaagcgcctacaagataactgggattactcctgttccattggctcagctgagcttttcttgtaacgaaggacctcagttgactgttgtccagtactttgctgaacggtacaactaccggttgcgctatactgcttggccctgccttcagtccggcaatgattctaagccgatatatttacctatggaggtgtgccaaatcattgaaggacagaggtaccctaggaagctcagcgacacacaggtgaccaatatactgaaggcaacctgtaaacgtcctcaggagagggaggggagcattattcagatggttcaccgcaacaactattcagctgataagatggcacaggtgtttgggatcactgtggccaaccagatggctaatgtgcaagctcgtgttctgcctgcacctatgctgaaatatcatgaatctggaagggagaaaacggttgcaccaagtttggggcaatggaatatgattaacaagaaaatggtcaatggtggaactgttcacagctggacttgtttgagcttttcgcggattcagcttcatatagtagacagaatatgcgaggacttggctcagatgtgcaattccattggcatggattttaatccaaggcccgtgacagaagttcagtcagcctcacccaaccacatagaagctgctttaagggatgtgcacatgagggctccaaatttgcagctgcttattgtcgttcttccagatgtttctggtcattatgggaaaattaagaggatatgcgagactgaccttggtatagtatctcagtgcatcaatccaaagaagaataaaaacaagcagtattttgaaaatgtcgcccttaaaatcaatgtgaaggtgggagggcgcaatacagtgcttgagagagcctttgtgcctaatggaataccttttgtctcagatgtgccaacaatcatttttggtgctgatgttacccatcctacagcaggagaagattcctcggcttctattgcagctgtggttgcatccatggactggccacaagtcacaacatataaagcactagtctcggcgcaagcacatagggaagagattatacaaaatctgttctggactggtacagatccagagaagggcactccagtgaacggtggaatgataagggagttgctgacttcattctttaagaggactggacgaaagcccaaaaggattatattttacagggatggtgtaagtgagggacaattcagccacgttttgctccatgaaatggacgcaatcaggaaggcctgtgcctctatggaagatggttatctaccaccagtgacattcgtggtggtacagaaaaggcaccacacaaggctcttccctgaagttcatggaaggagagatcttactgacaaaagcggaaacattcttcctggaactgtggttgatactagcatttgtcatcccagcgagtttgatttctacctctgtagccatgctggaattaagggaacaagcaggccaacacactatcatgtcctctatgatgagaaccgtttctcggctgatgctctgcagtttctcacaaacaacctttgctacacatacgcacgctgcacacgcgctgtttctgttgttccaccagcctactacgctcacctggcagcattccgcgcaaggtactatgacgaacaagagagcaccgatggaacctcagttgtcagtggtagcgccgccacagccggcggtggcccacctgcgttccgcaggctcccccagataaaggagaatgtgaaggaagtgatgttcttctgctgatgaaccggcgcgagctgctgtttgcttctattagtgtcgcatgcctttgctcctcagtatgcaagaggtgttgttagtttacaaacttagctgctgatgcaactttgagtatttgtggtgagttggtactgatggctgttctgactatattttgcatgagtgctgttaatgaattttagttgtggttt

SEQ ID NO: 786 - DNA, 2928 bp, Sorghum bicolor
atggcgccgccgccgccgccgccaccgccgcaggcgcaggcgcggcaccaccaccaccaccaccaggggccagccaacaagggcggcggccacgcggagcggacgaagcagccgctgcagagcagcgtgacgcagcccaaggcggagccaccggcggtggtggcggcggccgtgctgccggagggaggcaagcggtgcggaggaggaggaggagggaggcgccgcggcgggcgcggccgggccaaggcgccgccgggtgagtctcgtgctgcgctggcggtagcggtagcgccagcgccggcgcaggcgcctccgccgcgcacggtcattgggccgcccgtgccgagcaaggggctgtcgttctgccgccggccggggttcgggacggtgggtgcgcgctgcgtcgtcaaggctaaccacttcctcgccgagctcccggacaaggacctcacccagtatgatgtgaagatcacgccggaggtgagctcgcggaccgtgaaccgggccataatggcggagctggtccgcctctaccgcgcgtccgacctcggaatgcgactcccggcctacgacggccgcaagaatctctacaccgcgggcaccctcccgttcgactctcgcgagttcgtcgtgcgcctcaccgatgaggacgacggcaccggcgtgccgcctcgggagagggagtacagggtcgccatcaagttcgccgcgcgcgccgacctccaccacctcaggcagttcatcgccgggcggcaggcggacgcgccccaggaggccctacaggtactcgacatcgtgctccgcgagctcgccaaccagaggtacgtgtccatagggcggtccttctactcgccggacatcaggaggccgcagcggctaggcgacggcctgcagtcgtggtgtgggttctaccagagcatccggccgacacagatgggattgtcgcttaacatcgacatgtcgtccacggcgttcattgaacccctgccggtgatcgagttcgtggcccagatattaggaaaggatgtcatatcaaggccattatccgatgctaaccgaatcaagatcaagaaggcattgcgaggagtaaaagttgaggtcactcaccgggggaatgtaaggcgcaagtatcgcatttctgggttgacaacgcaaccaactcatgaactgattttcccaattgatgagcaaatgaatatgaaatctgtcgtggagtacttcaaggaaatgtatggtttcaccattcagcatcctcatcttccctgccttcaggttgggaaccaaaagaaggcgaactatctaccgatggaggcatgcaagatcgttgaaggccagagatacacgaagaggctgaatgaaaaacagatcacatcattgctgaaggttacatgccaaaggcctagagaacaggagatggatattctacagacagttcatcaaaatggatatgagcaagatccatatgcaaaggaatttgggatcaacattagtgagaagctaacctctgttgaagctcgagtccttcctgcaccttggttgaagtaccatgacactggaaaagagaaagagtgcttaccacaggttggtcaatggaacatggtaaacaagaaagtgataaatggatgcaaggtgagccattgggcgtgtataaacttctcaaggagtgttccagaaaacacagctaggggattttgccaggaattggcgcaaatgtgtcagatttcgggcatggaatttaacagtgagccagtgatgccattatattcagctagaccagaccaagtagtgaaggcacttaaaaatgtgtataatattgcattgaacaaactcaagggtaaagaacttgaacttcttttggctatcctccctgacaacaatggtccgttatatggtgacatcaaacgtatttgtgaaactgatttgggattgataacacaatgttgcttgaccaaacatgtttttaagatcagcaagcagtacttggcaaatgtctcactgaaaattaatgttaagatgggaggaagaaatactgtgctcctggatgcaataagttggaggattcctttggtcagtgacataccaactattatatttggtgcggatgtaacacatcctgaaactggggaggactcaagtccatcaattgctgccgttgttgcttctcaagattggccagaagttacaaagtatgctggattggtttgtgctcaggcacaccggcaagagctcattcaggacctttacaaaacatggcatgatcctcagagaggcactgtaacaggcggcatgatcagggagctcttaatatccttcaggaaggccactgggcagaagccattgagaataatattctacagggacggtgttagtgaaggccagttctaccaagttctcctttacgagttagatgccatccgtaaggcatgtgcgtccctagaaccaaattaccagcctcctgtaacatttgtggtagttcaaaaacgtcatcatacaagactttttgcaaataatcacaaagacagaagtagcatggacaagagtggaaatattttgccaggaaccgttgttgattctaagatatgccacccaacggagtttgatttctacctctgcagtcatgctggaattcagggaacaagtaggcctgctcactaccatgtcctctgggatgagaacaatttcacagcagacgaaatgcagacattgacaaacaacctttgctacacttatgcccggtgcacacgctcggtttctgttgtccctcctgcatactacgcacacctggcagcattccgggctcggttctacatggaaccagagatgtcagagaaccagacgtcaaagagctccaatagcacgaacggagtctcggtgaagcccctgcctgctgtgaaggagaaggtgaaaagggtgatgttctactgctga

SEQ ID NO: 787 - DNA, 4175 bp, Sorghum bicolor
ccgccggggaggtggtaatggcggaagaagatccgctgccgccctgcgacccgcagacgcaggcgagatggtaccagctcgaggcgctggagcgcgcgctggccgggaacacgctggtgttcctcgagacgggcgccgggaagacgctcatcgcggtgctcctcctccgccgcttcgcgaaccgcatccgctcgtccccgccgccctgcttcgccgtcttcctcgtccccaccgtcgtgctcgtgtcccagcaggcgcgcgtcgtccgggcgcacacggacctcaccgtcgccgagttcttcggcgagatgggcgtcgacttctggaacgcggacaagtggcgcgacatggtcgacggggccgaggtgctcgtcatgacgccgcagatcctcctcgacaacctccgccacagcttcttcaggctccgggacatcccgctcctcatcttcgacgagtgccaccacgccaccgggaattcgccctacgcctgcatttttaaggagttttatcatccccaactgaattctaggccatcagatcctattccaaggatatttgggatgacagcttccctaattaattcgaaagatcttgcgcgtgacaaatattcaatgaaaatatctgagctcgagaacctcatgaatgcgaaggtgtacactgttgccagcgaatcagagctattgcaatacattccatttgcgactacaaggataatcgagtatgatgattatatcgtaaagtctgagttatatagccatactatccgttgcttggacaaattggaagcgaagcatttagaaatcctgaagggcaaactgcatggttcatatttggaaaatgcagagaaaaggattaaaaaattaaatgcaatgttcttatattgcatatctgatcttggagtatggctggcagcaaaggctgctgagattctacaatcaaacaaggaaagctgcgtatccttttggggtgaaaaactggatgacgaagttgagggattcattagaaactatattggtgacgtaaataatgaactgtcagaaattatattgaagatgacaaagaggggtttacaacggcatattggtgaggactttgatgcggatttgcaagatgggttattgaaatccaaagtttattttcttatcaaatctcttttggagtataggcatgtgcaagatttgagatgcattgtttttgttaagagagttattacaagcattgtgttggaggctcttctgtcaactattaatcaaatgtctggatggagtgtaagatacatggcagggaaaaattttggtttgcaatatcagagtaggaatacgcatgtggaaattgttgattcatttcgaagtggaaaggtgcacctaattattgccacacaaattttggaggagggactggatgtgcccagttgtaacttgataatccgctttgatcaggcagcaactaatgtggatggtggttgtctttttgatggcgtccgtgacacgtctgttttctgtttcgacgggggggacgccaatgctctttctaagacagaggagtttctcgaaagtggacaaatcatgcgtgaagaatctcagagattggaatctactttttatcagcctcttccaaacaccctatgcaatgaagaattttatggtgttcaatctactggagcaattgttactctgaactctagtgttcagttgatttactttttctgctcaaagctaccttccgatgagtctgttttctttcttagattagacaatgttttcttttggttcatacaacaaaacatttcctggtattttaatcctctaccaagattcaatattgacaaggcattaggtacatgtacgctgcatcttccaatgagcagtcccgtacaaacaatttatgctgaaggagaaatttctatcatcaagagggttgtttgtcttaacgcctgtcgtgaattacatgctgttggtgctctcacagattatctcttacccgaatcgagtgttccatgcgaagatgaacctgacattgttgtggacaaatacaaggaggagcaacctgactactttccagaacaattaatggataattggttgtctttttgtcatcgtggcttatattattgctacaagatctcactggaaggttgttctgaaacaactactccagctgagatagtattagctgtaaagtgtgatttgggatctgacttcatttcaaccacattcaaattgtggggtgtgcaagactatttgagttttaccataagatatgttggtgtgattcatctaaatcaagaacaggtaattgtcgccagaagatttcagacaagaattctttctttgcttattagtaaggacctttccgaagacggcaattctattaagagtttacttgaaatgcaagtatcttctggagctgtgtatctacttctgcctgtagtttctggaaaaattgattggtgcagcatcaaattctcatcctcagaaatgcatgaagatactatcatggatagtagacacagccattcttgtaaagatactggtttgctgcagacaaaaggtggccctttctgcccatgcatgcttcaaaattctattgtctccaccccacataatggcatgctctatgctgtttctgggcttcttcttgacttgaatgctaattcgcctatgcgtgagagtgttcttagctacaaaacccattttaaagaaagtcatggccttgacttaaaatgtgaagatcaacctctcttgcgtgccagtaaacttgtgaaagtgcggaacatcctccatgagcgcaactataaaaaagaaaaagaaagtacaaatgtgtttgaattgccacccgagctctgcatagttgtcatggcgccagtgtcagcaaataccctgcgctgcttcacatttattccttctataatgtatcgtatccaatgtatgcttctttctgtgaatttgaaaacgcaattgggtccaagcatgaagcagttcgatattccagcactaaaggttctggaagcactaacagcaaagaaatgcaaagaagaattttcgcaggaatcattagaaacacttggagattctttcctcaaggcctgggctttcgctgctgttgtcaattgtggaatattattcctcctttggcgctcagaccaggcaaagggatacattcgaagcgaaactttcaaccctgaaacgtggattattccaggggttggcaatgactcatgtggtaggagtctgaggaagcttaaaagtaagaggatcgcagattcagttgaagccttaattggggcatatcttagtgctgctggtgagcaggcagcgtatcttttcttaaaatctttaggaatggatatagagtttcacaaaatgccagttgaaaggaaaattacaatcaatgcggagaacttcattaaccttagaagtttggagctaatgcttgactataatttcagtgatccatcattgttgttggaagcactgacacatggttcatatcagattgccggcactactgcatgttatcagcggctcgagtttcttggagatgctgtattagatcatatttttaccgattatttctaccatcagtaccctgaatgcactccagaactgttgacagatctgagatctgcttctgtgaacaatagctgctatgctcatgcagcagttaaagcaggattacataaacatattctacattcatcatctgcactgcacaaaaagatggctgactacctcgacaagtttgagcagtcattttcaggtccatcacatggttgggaagctggcatctgtttaccaaaggttctaggtgacgtaattgagtctatcgctggtgcaatctacattgataccaagaacgacaaaaaggttgtttggagaaagatgaaacggctactagaacctcttgccacccccgacactcttgaaattgatcctgtcaaagagctgcatgaattctgtgatcctaaaacgtgcagtatcaagtacacagtagctcgtgaggaccgggtaacctcggtggccgtagaagtacagaccaaagggactacatacaaggccactcggacaggcctcaccaagcgtgacgccaaaaagttagcagccaaatccgtgctcaaagatatgaaggccgcgaatagcacgcagcattttgcaaatggtatcagctgcacttaa

SEQ ID NO: 788 - DNA, 2297 bp, Sorghum bicolor
atggagcactttgtggagttacctccagaactatgctctttgaagataactgggttctcaaaagatatgggtagttctttgtccttgctaccatctttaatgtgtcgcttggagaatttgttggtggctattgagttgaagaatgtcatgtcatcctatttcccagaggcttctcaaattagtgcctcgggtatccttgaagcactgactactgaaaggtgtttagagaggatctctttggagagattagaagtcctaggtgatgctttcttgaagtatgtagttgggcgccataactttatttcatatgaaggacttgatgaaggtcagttgaccaggagacgttctgatatagtgagtaattcaaatttatacgagttgtcaattagaagaaatttgcaggtatacatacgggatcaacactttgaacctactcagttctttgcattgggaagaccttgtaaagttgtttgcaatcctgacagagaagcaactttacacccgaagaatatcgacccagatagacgtgaaaactgtaacttgaggtgtacaaaatcacatcattggttgcataggaagacaattgcagatgttgttgagtcacttcttggagcttttcttgtcgagtgtggattcaaagctgcatttgcattcctacgttggattgggataaaagttgatttcgaaaattcagctctctatagagtattagatgcaagctccaccaatttgtctctcatgaattacatgaacatttctgagcttgaagaattgattggctacaccttcaagcacaagggtcttcttctccaagcatttgtacacccttcattcaataagcattctggaggatgctaccagaggatggagtttcttggagacgctgttttggattatttgatggcctcgtacctctactcagcttaccctgatctcaagcctggtcaactaacagatctgaaatcattagctttgaataataattcatttgcttatgtggccgttaagaaatctatccataaatatctcataaaggattctaaatctcttacggcagcgataaataaatttcagaattatgttaatctttccagttcagagaaagacttgttagaagaaccaacttgtccaaaggttcttggtgatattgttgaatcttgtgttggtgcggtgcttttagattccggcttcaacctgaaccatgtttggaagctaatgctaatgcttctaaagccaatattgagcttctgtggcatgcacatcgatcctatgagagaactcagagaaatttgtcaatataatggttttgagttaggacttcccaaacctacggaggacaatggagagttccatgtcaaagtagaagttaacatagatggcaagatgataagctgtactgcagcaaaccggaattcgaaagatgctagaaaggtggctgcacaagaagcacttttgaaactgaagaataatggatacaagcataaaagaaagtcactggaggaaattttgcgtgctaccacgaaaaaagaatcagagctgataggctatgatgaagaaccaatcaatgttgaggatgacatacaaatgaagaatctattgataaatggagaaatggaaggaaacatcttttttcaaaataaagaagtgtctttgaacgggaggtctgaaacctccattcagagtacaacaggagataacaaggttgacaagaatgatgctaataatggaaggaacaataagtccaatgtggtcgtgcagaatggttgtctacctagaggggcaactgataaaacaaaccaaagagagtatcatggtgacatggtacgcaaaacagcaaggtcattcctttatgaactatgtgctgcaaactattggaaacctcctgattttgagttatgcaaaggtgaaggaccaagccaccttcgaaagttcacttgtaaggtccttattcagatcacgggaacttcagcgacccttttggagtgctatagcgatcctaagctacaaaagaaagcagcgcatgagcatgcagcagagggagctctgtggtatcttaagcaacttggatacctaccaaaagatgattatcgtgtctagcgacattttaggtttgtggccttcagtgggaagagttttgttattgtaaataggcctcagatggaagagttttgttattgtaaataggcctcagatggaagagtttttttattgtaaacatgcattttgttcagagatatattgacacatacgaagctcacataggataagaaactagcaaatacttcctctatctcaaa

SEQ ID NO: 789 - DNA, 9246 bp, Sorghum bicolor
ccataatttttagttgtagagatttagtgtttcatacatatgctgtaagatttatgcaatggagaatctaaggccttgtttacttcccagaaaattttacaaaatttttcacattccccgtcacatcgaatctttagacgtatgcatggagtattaaatatagacgaaaataaaaactaattgcatagtttggtcgaaattgacgagacgaatcttttgagcctagttagtccatgattggacaatatttatcaaatacaaacgaaaatgctacaccaaaatttttcagaactaaacaagcctaaataagacctgagtcactgacggagaaggaaatgcggcaaccatccttttccaaggctgcccaagcaaaccgcgaaaacggaagcgacacaccgcccggcccggccgcagggaggacgctctctgctagcctgcgcgacgcttgcgttgccgctgccaccgccgccgcgctgttgaatgctccgggtccacggtgcaccaggcggaaggcgagacgccaagcacggtgcggggcctacttgtgtgtgggacgaagcccgtagacccggtgcagctggagggttggagccaggagcgcagcagcctttggacgccgacgcggggataccgccgaggaggtcctaacggtccgatgacggcgccgtaagctaacggcttcttcggcttcgatccgcctgctgcatgtccaggtgtcctccccgcacggccgtcggatcgccgcgaccgcagctcctccgtcacgctaacgccggtaccagaccggatgggacgcactgtgggctcgactgctcgggcggcggtctgcagtgacacttccggggagcgacaccttatatctcactgattggtgggaccagatatcacgcggacccacgtgtcattgatggggtgggattgcgccaggtcgccaccggggtgcgtatggagggcacacacacagtcaggtctcaggatatggttcgccgcggagggccggaggcagcagcgttccctcgacccggcagaactcaccaaagacaatgactagtggggtacaattttacggggcccgcaagtcagtggagtagttgttgcgtccgatgccgctttggcgtgcaccgaggaagtggagagcacggtgggcgttagtgcgtgaggtgcctaccgctaccgcgtccagtcctcccctccacgtgtcacctcgtctgggccccaaagttccgggctctcccaacgcacggtcaagatgggccgatcggagggccccgctagcagagcgcaccgcgcgggcgggcgggcgggtgcggaatgacctcgctgcccttctcgtccccgtcgtacaggagggcagctggtacaagaggggggtgggtgcgggcagaggagccggtgttctgtttggaaagccggagggggtgagaagttttctcgccttctcggagacgtcgccatccaccccccgcttccaccactctcggcggtaaccgaaaaccctcccctcctgttcctctctcacactcccccgcttccttccctgttcgtggaaatctagggttttggaagggtttagatcgcctgctctttgccgcggcggttgttcgtgcgccgcggatttagggagggtttctgcggtgaggggttttgcgccccctggcggtgtgttcttcgtttcttcggggggttttttaccctctttggtgtcaggatcgctgcattccggtctgcgcttagagaggtgttgtctttgtggatggattctgtttgtctaggtttttggtggattttcgtgcggttttaggatttttgttgttgttctccatcgagcaggtcgagttttttttcaagggtcattgatggtgtccttgtggcgcgcatgtgacagcgtttgggggttttgttttgtggattgattcttttttattatgccttaccgattttcatctttttttttcacatggagggttttcttgttttcgtgtttgcaatggcgaaggtgtgatttttgctcttttttcgtcgcgcatttgttcttgtcatgtttaaggcttatttttctcctcttttttgagcctttctacgtacaaaatggaggagcttattccggttttcttctttgttatctttaaaggagattatttttatttatttttgcgcgttttctgtagctggtcttatggttctccagttccatcacattgaagaagatctgcgccttgtttagaaacaaaaatcttttcaagattccccgtcacatcaaatcatggagcacatgcatgaagcattagatatagacgaaaataaaaactaattacacagtttgcccgtaaatcacgaaatcttttgagcctagttagtccatgattggataatatttgtcaaatagaaacgaaaatgctacagtgccgaaatccgacattttttcggaactaaacaaggccctgatttttatgtgtttttggggaggtttatggtggcactgttcatttctctggataaagattttaatcgaaaactcatttggtgtttgaaaggttcgttcttaataatatcagtgcgttgttctgaagggttcattcataaaggttttagtgcggcgtcgttgttaatttgggggtacgtgctgcaatttcctttgcctttttttttggtttcttggagtcctggaaatttcgccatgacattccaaaggaattttttttcttgcctttcttcccggatgtgttcccctttccaaatcttttgcatattttggtttctatatagatatatgattacataactcttattgtaatttgtttacattctcctttgtttattgttgttttattgttatacgatatgatatgcggatatgatacaattcgttttcatttgttgatgtgcagggtcgggcagaggctttgcagctttgggtcagatacagtgctctcgtgagtatattaagccacatggtttacaatttttgtttgagcatgtagaacggctcctataaaggacagtaggatgtttcggcactagttctgtcactagcaaatcttctgtggactgtggtagtgttttgaggtccttgtttagtactgtttccatagtttgttgtttattaacatttccatagtttgtgagatgatcacaatttcattttttgtgtttttaaatttgttaaatcacagcaattgtgctttgcctacctgtaccattcttgcatctatactatgcagtcactttttctcttactgctaaattgtataaagtatgaggaaataaaacaaatgctagatatttaactgttccagtttccaattgatataagtggaatatcttctattgctattagagtagtctgggctgcaaaataataaagtatcctgatgttacatttgtgttgtgtatttggtggacttgagagtaaacattgtggtttactgaaatgtatactgttaagagaatgtgtattgttgggggtgtggtataagttagggaccccccattagtgtgtaataaggcccaattactaatcataggggcctatttgtgagtgtttaggaaccagttgcagtttgtaggatttcatcatttcttatagttcatgtttctattctgctgcccttgaaaatctttagcaaagtaaatggcaacttgaattcctagtttttgttgcttaagcttgttgtactatgccgaaatcagatgtttaatctctgtttgaagtgtgatttacctgtatacttgtccttctgccacttcagttgcattgctgcttgcttgaatcatacagccagttcctatgtatatgtcttattggggttcctttggatatcactcatgcagcaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtacgtctcttatccttgtctagtgtcatctctttattttcatcctcataccttcattattgatgctgttatcttttattggctgcaggtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagtaagcctcagttattttgatcgatttgtcattatctactctgataattatccctaaagattaacttgactatcttgctttcaggactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagtatgtaactgtttcatgcaattcagtattacaaatattgctgatattattgatggttcttgcagtgtagccattctgtcttttaactgtgtccctttttgcttgcaggggttgcctattagtaaggcaatcattcttccacaataatccttctaactttgttgacctgggtggtggtgtagtgggctgtagagggtttcattctagttttcgtgcaacccagagtggactttcactcaacatcggtctgttcttgtacccattttccctgttttaatctatacaatacaatgatcatttctctctatgcagttaggtggtaatgtttgcatgtgttaatatgttgtgcagatgtgtccaccacaatgatagtgaaacctggtcctgtcattgattttctgcttgccaatcagaaagttaatcatccaggcatgattgattgggctaaggtaaggcttcatgcttaatacaacaaataggaggttgagttccattgttccatttcaccatactttggatttatatttttgcaatttgttatacttatgtaggccaagcgttcactgaagaacttgaggatcaaaacaagtccagcaaaccaagaacagaagattgttggtctcagcgacagaccttgctgtgagcaattgtaagtagagtgatgtgttgttgtttgaaatgtttttatattgtttgcactttattttgttctccaacctcatcctgagttctgcatcttagttatttacatcttctaagtacttggtgatttacttgcgtatgtagattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgaggtaactattatttgaatcctagtgtttttcctttgctgtaaagctctttccctctaatgttgtgaagattgtttctgtgtttaccagttatgcagtcttttgcctttacaaaggtacactaaagctttgagcacacttcagaggtcatcacttgttgagaaatctaggcagaaaccacaagaaaggataggtgttttgtctgatgtgagtgtttttgtcaattaaacctagcaaattttccttttgttattatatataccaataacaattggcctagcaagttgggttatagccttatggtgtggttttcttgaaacttcaaattttttttcatgtcaaattgggtaggtactgcaaagaagcaactatgatgcagagcccatgctgaaggcctgcgggattacaattgctagaagttttaccgaagttgatggtaggatactgcagccccccaaggttggtcattactgtttatcctttatcatttcagatgttctttgtggttatgaaattttgaaggcataaattttttctgtcctatggttcagcttaaagctggcaatggagaagacatttttacacgcaatggtagatggaacttcaacaataaggtaagaatgtatagtatattctttcttttgtgtatgtggattttcgtgatgccacatgtaatatttggaattctgtttttcagaggctcattaagggtagcagtgttgagaaatgggcagtggtcaacttttctgcacgatgcaatgtcagggatcttgtccgtgatctcatcaagtgtggaggcatgaaggggattgtaagtttattttctcattatgttgtgcatttccagatgtgctctaattcatgtttgggatttcatttccacatgttcttatttacttgtttcgtgttgcagatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatggttggttactactaaatcgctgttaacttctgtggcacattttgtttgttctgtatcactatgccattgacctttacagggccttggaagaagaaatgccttgctgaatttgggatcgttacacagtgcgtggcaccaactagagtcaatgatcagtatcttacaaatgtcctactaaagataaatgcaaaggtctgtttctctttaccatgagatttgagagcatggcaacatttgtacattgcaattacatatttttggtatttcgtcccttttcaaacagctgggtggcatgaattcgttgctccaaattgaaacatccccagcaattcctcaagtatccaaggtcccaactataatcttgggaatggatgtctcccatggttctcctggacattctgatgtaccgtccattgctgctgtacgtataatttttgtagttttctgtgataaataataaattgtagctactgtgacagtttatattttgttttcttaggttgttagttctcgtgaatggcctcttatctcgaaatatagagcttctgtccgcacccaatcacctaagatggaaatgattgactctttgtttaagccacgggaaactgaagatgatggtctgatccggtaagagatttttacctgcattctcattgttaagtttcataatgttttactttgctgaatatcctttatgttctaatgacgagctttctcccattactcgttggaatttgatgttgcttcagggagtgtctgattgacttctacaccagttctgggaagaagaagcctgaccaagtcatcatcttcaggtctgttaataattaggcaaactaacttttttgtggaagtaactgtttggttcagaaaattggttgcctatctcttgtttcctctgttttgttatagcaccaagctaatttgtgactaattatagggatggtgttagtgaaagtcagtttaatcaggtgctgaacattgagttgcaacaaatcatcgaggtatattttttgttagcaactctattggcaagttctatttgtgttgtcatgctttcttttatccaagtatcctgtactgtgtgctttgtccatattaacatggtcctattacctcttcaggcttgcaagtttttggatgaaaaatggaatccaaagttcacgttgattattgcccagaagaatcaccacactaaattttttattcctggaaagacagaaaatgttccagctggtaatcttcatcaacctacttgtcccttgttgcaattgtgtaggctcatttattggtggccttataattattattattattctctaatcatctcaatggttttatctgcaggaactgttgtggacaacaaagtttgtcatccaaggaactttgacttctacatgtgttcacatgctggaatgatcgtaagcataacctgcctttgtatttggccgcagtccattgttgtcgttttgagtttgttagtttgccctgaaatgagaaatgcccttcatttttaaccctacactgaagcaactgtgttctgatttaaactgccaagtgccttcacaccaccatgttgtaatctcagctgtaaaaatctccttgtgctgttgccaccttttttcagtttgtatcctagaatttaactgaaacttggttctgctgtcgcaagtttgcctaggtagaaattattgtttccctgtgaattgataaagctaattgcatgttttatttttgccaggggactacgaggccaactcattatcatatactgcatgatgagataggcttcaatcctgatgatctgcaggagctggtgcattcgctctcttacgtgtaagtaccaagcagaggctctaagaaaacttttgctacctttttgttttgttattatgaaaaacttgcgtgctcacaagggattttctgggttcttatttcaggtaccaaaggagcacaacagccatatcagttggtaggtttacttgggcaccttttctttttctgtgtcactgtcacctccagtagcttttgtgtatcagatctgcgggaactgattccattgtttgcctgcctgcagttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctcta

SEQ ID NO: 790 - DNA, 9347 bp, Sorghum bicolor
tgcatgtatggatgagtgggcctaggttgatgggatagcctattatggctaaaagggatgagagttgtggcttcaccatgggtgtggtagatgggtcctttccataatttttagttgtagagatttagtgtttcatacatatgctgtaagatttatgcaatggagaatctaaggccttgtttacttcccagaaaattttacaaaatttttcacattccccgtcacatcgaatctttagacgtatgcatggagtattaaatatagacgaaaataaaaactaattgcatagtttggtcgaaattgacgagacgaatcttttgagcctagttagtccatgattggacaatatttatcaaatacaaacgaaaatgctacaccaaaatttttcagaactaaacaagcctaaataagacctgagtcactgacggagaaggaaatgcggcaaccatccttttccaaggctgcccaagcaaaccgcgaaaacggaagcgacacaccgcccggcccggccgcagggaggacgctctctgctagcctgcgcgacgcttgcgttgccgctgccaccgccgccgcgctgttgaatgctccgggtccacggtgcaccaggcggaaggcgagacgccaagcacggtgcggggcctacttgtgtgtgggacgaagcccgtagacccggtgcagctggagggttggagccaggagcgcagcagcctttggacgccgacgcggggataccgccgaggaggtcctaacggtccgatgacggcgccgtaagctaacggcttcttcggcttcgatccgcctgctgcatgtccaggtgtcctccccgcacggccgtcggatcgccgcgaccgcagctcctccgtcacgctaacgccggtaccagaccggatgggacgcactgtgggctcgactgctcgggcggcggtctgcagtgacacttccggggagcgacaccttatatctcactgattggtgggaccagatatcacgcggacccacgtgtcattgatggggtgggattgcgccaggtcgccaccggggtgcgtatggagggcacacacacagtcaggtctcaggatatggttcgccgcggagggccggaggcagcagcgttccctcgacccggcagaactcaccaaagacaatgactagtggggtacaattttacggggcccgcaagtcagtggagtagttgttgcgtccgatgccgctttggcgtgcaccgaggaagtggagagcacggtgggcgttagtgcgtgaggtgcctaccgctaccgcgtccagtcctcccctccacgtgtcacctcgtctgggccccaaagttccgggctctcccaacgcacggtcaagatgggccgatcggagggccccgctagcagagcgcaccgcgcgggcgggcgggcgggtgcggaatgacctcgctgcccttctcgtccccgtcgtacaggagggcagctggtacaagaggggggtgggtgcgggcagaggagccggtgttctgtttggaaagccggagggggtgagaagttttctcgccttctcggagacgtcgccatccaccccccgcttccaccactctcggcggtaaccgaaaaccctcccctcctgttcctctctcacactcccccgcttccttccctgttcgtggaaatctagggttttggaagggtttagatcgcctgctctttgccgcggcggttgttcgtgcgccgcggatttagggagggtttctgcggtgaggggttttgcgccccctggcggtgtgttcttcgtttcttcggggggttttttaccctctttggtgtcaggatcgctgcattccggtctgcgcttagagaggtgttgtctttgtggatggattctgtttgtctaggtttttggtggattttcgtgcggttttaggatttttgttgttgttctccatcgagcaggtcgagttttttttcaagggtcattgatggtgtccttgtggcgcgcatgtgacagcgtttgggggttttgttttgtggattgattcttttttattatgccttaccgattttcatctttttttttcacatggagggttttcttgttttcgtgtttgcaatggcgaaggtgtgatttttgctcttttttcgtcgcgcatttgttcttgtcatgtttaaggcttatttttctcctcttttttgagcctttctacgtacaaaatggaggagcttattccggttttcttctttgttatctttaaaggagattatttttatttatttttgcgcgttttctgtagctggtcttatggttctccagttccatcacattgaagaagatctgcgccttgtttagaaacaaaaatcttttcaagattccccgtcacatcaaatcatggagcacatgcatgaagcattagatatagacgaaaataaaaactaattacacagtttgcccgtaaatcacgaaatcttttgagcctagttagtccatgattggataatatttgtcaaatagaaacgaaaatgctacagtgccgaaatccgacattttttcggaactaaacaaggccctgatttttatgtgtttttggggaggtttatggtggcactgttcatttctctggataaagattttaatcgaaaactcatttggtgtttgaaaggttcgttcttaataatatcagtgcgttgttctgaagggttcattcataaaggttttagtgcggcgtcgttgttaatttgggggtacgtgctgcaatttcctttgcctttttttttggtttcttggagtcctggaaatttcgccatgacattccaaaggaattttttttcttgcctttcttcccggatgtgttcccctttccaaatcttttgcatattttggtttctatatagatatatgattacataactcttattgtaatttgtttacattctcctttgtttattgttgttttattgttatacgatatgatatgcggatatgatacaattcgttttcatttgttgatgtgcagggtcgggcagaggctttgcagctttgggtcagatacagtgctctcgtgagtatattaagccacatggtttacaatttttgtttgagcatgtagaacggctcctataaaggacagtaggatgtttcggcactagttctgtcactagcaaatcttctgtggactgtggtagtgttttgaggtccttgtttagtactgtttccatagtttgttgtttattaacatttccatagtttgtgagatgatcacaatttcattttttgtgtttttaaatttgttaaatcacagcaattgtgctttgcctacctgtaccattcttgcatctatactatgcagtcactttttctcttactgctaaattgtataaagtatgaggaaataaaacaaatgctagatatttaactgttccagtttccaattgatataagtggaatatcttctattgctattagagtagtctgggctgcaaaataataaagtatcctgatgttacatttgtgttgtgtatttggtggacttgagagtaaacattgtggtttactgaaatgtatactgttaagagaatgtgtattgttgggggtgtggtataagttagggaccccccattagtgtgtaataaggcccaattactaatcataggggcctatttgtgagtgtttaggaaccagttgcagtttgtaggatttcatcatttcttatagttcatgtttctattctgctgcccttgaaaatctttagcaaagtaaatggcaacttgaattcctagtttttgttgcttaagcttgttgtactatgccgaaatcagatgtttaatctctgtttgaagtgtgatttacctgtatacttgtccttctgccacttcagttgcattgctgcttgcttgaatcatacagccagttcctatgtatatgtcttattggggttcctttggatatcactcatgcagcaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtacgtctcttatccttgtctagtgtcatctctttattttcatcctcataccttcattattgatgctgttatcttttattggctgcaggtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagtaagcctcagttattttgatcgatttgtcattatctactctgataattatccctaaagattaacttgactatcttgctttcaggactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagtatgtaactgtttcatgcaattcagtattacaaatattgctgatattattgatggttcttgcagtgtagccattctgtcttttaactgtgtccctttttgcttgcaggggttgcctattagtaaggcaatcattcttccacaataatccttctaactttgttgacctgggtggtggtgtagtgggctgtagagggtttcattctagttttcgtgcaacccagagtggactttcactcaacatcggtctgttcttgtacccattttccctgttttaatctatacaatacaatgatcatttctctctatgcagttaggtggtaatgtttgcatgtgttaatatgttgtgcagatgtgtccaccacaatgatagtgaaacctggtcctgtcattgattttctgcttgccaatcagaaagttaatcatccaggcatgattgattgggctaaggtaaggcttcatgcttaatacaacaaataggaggttgagttccattgttccatttcaccatactttggatttatatttttgcaatttgttatacttatgtaggccaagcgttcactgaagaacttgaggatcaaaacaagtccagcaaaccaagaacagaagattgttggtctcagcgacagaccttgctgtgagcaattgtaagtagagtgatgtgttgttgtttgaaatgtttttatattgtttgcactttattttgttctccaacctcatcctgagttctgcatcttagttatttacatcttctaagtacttggtgatttacttgcgtatgtagattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgaggtaactattatttgaatcctagtgtttttcctttgctgtaaagctctttccctctaatgttgtgaagattgtttctgtgtttaccagttatgcagtcttttgcctttacaaaggtacactaaagctttgagcacacttcagaggtcatcacttgttgagaaatctaggcagaaaccacaagaaaggataggtgttttgtctgatgtgagtgtttttgtcaattaaacctagcaaattttccttttgttattatatataccaataacaattggcctagcaagttgggttatagccttatggtgtggttttcttgaaacttcaaattttttttcatgtcaaattgggtaggtactgcaaagaagcaactatgatgcagagcccatgctgaaggcctgcgggattacaattgctagaagttttaccgaagttgatggtaggatactgcagccccccaaggttggtcattactgtttatcctttatcatttcagatgttctttgtggttatgaaattttgaaggcataaattttttctgtcctatggttcagcttaaagctggcaatggagaagacatttttacacgcaatggtagatggaacttcaacaataaggtaagaatgtatagtatattctttcttttgtgtatgtggattttcgtgatgccacatgtaatatttggaattctgtttttcagaggctcattaagggtagcagtgttgagaaatgggcagtggtcaacttttctgcacgatgcaatgtcagggatcttgtccgtgatctcatcaagtgtggaggcatgaaggggattgtaagtttattttctcattatgttgtgcatttccagatgtgctctaattcatgtttgggatttcatttccacatgttcttatttacttgtttcgtgttgcagatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatggttggttactactaaatcgctgttaacttctgtggcacattttgtttgttctgtatcactatgccattgacctttacagggccttggaagaagaaatgccttgctgaatttgggatcgttacacagtgcgtggcaccaactagagtcaatgatcagtatcttacaaatgtcctactaaagataaatgcaaaggtctgtttctctttaccatgagatttgagagcatggcaacatttgtacattgcaattacatatttttggtatttcgtcccttttcaaacagctgggtggcatgaattcgttgctccaaattgaaacatccccagcaattcctcaagtatccaaggtcccaactataatcttgggaatggatgtctcccatggttctcctggacattctgatgtaccgtccattgctgctgtacgtataatttttgtagttttctgtgataaataataaattgtagctactgtgacagtttatattttgttttcttaggttgttagttctcgtgaatggcctcttatctcgaaatatagagcttctgtccgcacccaatcacctaagatggaaatgattgactctttgtttaagccacgggaaactgaagatgatggtctgatccggtaagagatttttacctgcattctcattgttaagtttcataatgttttactttgctgaatatcctttatgttctaatgacgagctttctcccattactcgttggaatttgatgttgcttcagggagtgtctgattgacttctacaccagttctgggaagaagaagcctgaccaagtcatcatcttcaggtctgttaataattaggcaaactaacttttttgtggaagtaactgtttggttcagaaaattggttgcctatctcttgtttcctctgttttgttatagcaccaagctaatttgtgactaattatagggatggtgttagtgaaagtcagtttaatcaggtgctgaacattgagttgcaacaaatcatcgaggtatattttttgttagcaactctattggcaagttctatttgtgttgtcatgctttcttttatccaagtatcctgtactgtgtgctttgtccatattaacatggtcctattacctcttcaggcttgcaagtttttggatgaaaaatggaatccaaagttcacgttgattattgcccagaagaatcaccacactaaattttttattcctggaaagacagaaaatgttccagctggtaatcttcatcaacctacttgtcccttgttgcaattgtgtaggctcatttattggtggccttataattattattattattctctaatcatctcaatggttttatctgcaggaactgttgtggacaacaaagtttgtcatccaaggaactttgacttctacatgtgttcacatgctggaatgatcgtaagcataacctgcctttgtatttggccgcagtccattgttgtcgttttgagtttgttagtttgccctgaaatgagaaatgcccttcatttttaaccctacactgaagcaactgtgttctgatttaaactgccaagtgccttcacaccaccatgttgtaatctcagctgtaaaaatctccttgtgctgttgccaccttttttcagtttgtatcctagaatttaactgaaacttggttctgctgtcgcaagtttgcctaggtagaaattattgtttccctgtgaattgataaagctaattgcatgttttatttttgccaggggactacgaggccaactcattatcatatactgcatgatgagataggcttcaatcctgatgatctgcaggagctggtgcattcgctctcttacgtgtaagtaccaagcagaggctctaagaaaacttttgctacctttttgttttgttattatgaaaaacttgcgtgctcacaagggattttctgggttcttatttcaggtaccaaaggagcacaacagccatatcagttggtaggtttacttgggcaccttttctttttctgtgtcactgtcacctccagtagcttttgtgtatcagatctgcgggaactgattccattgtttgcctgcctgcagttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctcta

SEQ ID NO: 791 - DNA, 8630 bp, Sorghum bicolor
gggatcccacgtagtgatttttctggcgaaacagcaacatacaatttgtttgataaatattggtgatggataagggcactcctaatgcaagactctatcatagagttcaagacaattaatcacatattatttatggtattttgctgatgtggcaccgtatttattgaagaaagaggtagaaaaaataagactccaagtcttatttaaactctaagtccatattgttcgaggtaataaataactttagactctatgatagagtctatattgtgagtgccctaaagatttaacctgtatggaaatttggatattgattgatcctaattcctaaataggtattgtgcgtgtttgttacgaatttataaggcgaggcagacatccacacgtgagttgcaaaccaggagacgacatgagtgatgcgaaaccaatggaggttttgcaactcgaaaaccaagagaataagaaatgacaactgagagaccggagactagctatggacggacgggcagaggagacagtgagagataaaataaataaatttaccacttttataatgttaaccgtaaatatttacaaatatgctcaagcattatgacaaggcatacaatttgttgtggagtgttcgtgccaatacaataagttagctatttttctaggatttaattattttatggctcaatcttaaatcaaataattgcaacgtgtaacaaaagaccaatctcgtatagaaaaagtgaatgaagattgagtcgacttaaatgtcaagcaattatatataccaattatgagtttaagaaaaataagctacactttcatatatgtgtcgagatgcatatgattatactcctttcatcctaaaataactatcgtttgtgcatctcaagaaaaactttgactaatatatatattaaaaaatattaatatatattattcataactagtaccattagaaaaatgtttgaatctacttttttaataaatttatttggatacataaatattacatatattttctacaaatcaagtcattacatgttatgatgagctaaaagtcatggcatgagtgttgtagtgccaatggagattttacggctttaaacttaaaaagcgagaccgatagtgtcttaaaacagtactaaatatattatgtcaaatttaactgaattatataaaaatagtaatatttattatcataaataggtattattagattttatgaaatatattgttatagtatgtatatatattaatatgattccttttataaatttagttaaatttaagatagtttaatttaacgaggcctagaactatagaggagaggtgtagatgggccttatcatctttacatgtccacttttcaggcccggcccagctgaatgtccagatgaacgtgggctggccggaggagagaccgaggtggagtgtaaagctgcccgccgttcgagggagcagctacgcatttaagctgggggcagtcgcagcagtgagtgggcagttcaggcttcggggactggaggagtgggagaggagaggagcaggacctgggagacctcgcttcgcccgtcctccagtcttccttgcttttcgattttggtaagtggaagtgattccaatccttcctccttccctccccctgtttgatttgatgctatgtgattcatgtcttgtcctgttgtccatgcactatttacaaatctgcaatgctgctgcatgcgtaaaccctagccccctcgccgctgaaaccccccacccccattcgttcctctttcatttcttacggcagatgcagcttctgctttcctagggttttcgggacatttggttccttgcacccagaggacgaagagctgagtccctttcctgctgccgctcttggtcctcacactcgcagatttgtttatctttctttaaaaaaagagaaggggggagggaggatagccccctttggatttttaggggttcacacgtttctggatgcttttgcagcgatgcgattcatctcacaggggtttcctaaattaccgtgcctttttttgggaaataaaaaataaatgtccactcttttgtgtaggccttgtttagttccgaattttttttgtttttcgagaccgtagcacttttatttttatttgacaagcattattcaatcataaagtaacaggcttaaaagttcatctcgcgatttataggtaaactatgcaattagtttttattttcatatatgtttagtgctctatgcatgtgccgtaaaattcgatgtgacggggaatcttaaaaagtttctggtttttgggtgaactaaacaaggcttaagaaaaacataaagacgagtgcttgaagctgcgatgtctgctgttcaggtggtttctcaagaacacttttttaaaataaaaaagcccatttttttttctgggaatgtgaaagaaggtgcatggtgccgttaagtcgtcaacttcaccaaaagcttccatcttttttcccccttacctaaaccttgtttcaacaaaatgctgcctttggccaggggcatctgattgtcttttaaatctgtgattctttttttagaaggaaaaaaatctgtgattcttcgagtcaacattacgctcattttcttcactgtgatctggcaacctacagtcgtatttctttattattagtaatgtcctgcgctcgagttcttgtgatctgcacagtataatgctgccaccaaaaggatgcaattagacaagcttaatggtgcatctgatagactgtacaaaaagattcgtgtcccaaatgtgtccttgctaatcaaggaggtcatatgaacaagtaaaacggaatttctgcattagcaaacaggcacaagactgagtgacgtggctagtgccaatgagttgtgaactcgggaatggaattagagttatagctattcctatcatttatttcaccacagaggctttgcattttacctgaatctgataaagaagtaggcagaaacatggagcttatagtgttgaagattgtaggtatagaagctaggtatcagaaagattcaactttgtgattgtatgctgcacatggtattggtaaaacattctttcaagtgctcattgtcttcccttgcaccaattcattgttgtccttgtttctttgcagagggtgctgcttgttttatcttaaaatggggtctcatgatggtgaggatgaagagttgccaccacccccgcccgtgccaccagatgtggttcccattaaagctgaagatgttgtgggggaaccaccagcaaacaagccaataaagccaaagagattactgatggacaggcctggtataggaagaaaagggcagctagcccagctctattcaaatcactttaaagtcgccgtgaagagcacagaagacttcttctttcactattatgtatgtcttcttactgagttcacaatcttctgttcaaaatatatcattgtgtgtcccttgtttgttaataacttatctttggctgatgagatagtgctgttttatttgaataggtgaacctgaagtatgaggatgatcaacctgttgaaggtaaagggattggcagaaaggtgattgataaactgcagcagacatatcgcgctgagctttccaacaaggattttgcatatgacggagaaaagagcctgtttacagttggtgggcttccacaaaaaaacaatgagttcactgtcgtcttggaggacgcgtctactggaaagttagttttattctttgatctgctttcttgtttatgcttaggccttgttcagttggcaaaattttgatatccaatcatggagtaactaggcttaaaagattcgtctcgcgatttacaggcaaactgtgtaattagtttttattttcgtctttatttaatactccatgcatgcgccgcaagattcgatgtgacggaaaatctaatttttttttgggaactgaacaaggccttatccagaatcttactttgtaattgcgatgtttgtttgtttatttatttatttattggttgtaggactgctgccaatgggagccctggcggtaatgacagtcctggaggtggtgacaggaagagagtgaggaggccataccagacgaaaactttcaaagtggagataaattttgcagcaaaggttcctatgagtgctattggtcaagtcattagaggcgaagaaacggagaactccctggaggcacttcgtgttcttgatatcatactgaggcagcattccgcagaacagtatgtagctatgcatcttcatggatgatttataggtagatttgaggatcttctgcagttagatcatggcaatttttctcactacttgcagaggctgccttttggttaagcaatcgtttttctacaacaacccttcaaactttgttgacttgggtggtggcgtgatgggttgccgtggatttcattcaagtttccgcggcacacagagtggactttccctgaacgttggtacgtatttgtcctgtattgctgtactggtgccatgtaactgcattgtctattatgtaatcttttacatctttcatgatcacgatagcttattttttgaaatccgcagatgtctcaacaacaatgatcgtgaagcctggccctgttattgattttcttctttctaaccagaatgttaatgatcctagcagaattgattggcaaaaggtaaattgcatctttggatataactttttgaacgatcacgctactgcattgaaatatctattttggtagaatggtaacactattttggggtgtgcatattcaattcaggccaagcgtgctctcaagggcttgaggattagaaccactcctgcaaatgcagaattcaagatttttggtctcagcgagaggatttgtaaagaacaaacgtgaggacatgttttcttgctgttttgtttatttcatgcgtgctttacttggtatttgaaaaaaaaaaaatgtaccctagtgtgtagcctgtttcagaagagttttgttcagcaagtattgcttttattaattgtgttctgatatcaatgccaagcttgtttgacagagatattcttgtgcttaattgctttctcatcaacatatgcaattaggtttccgctgaggcagagaaatggtagcaacggagattgtgataccattgatataactgtctatgactactatgcgaagaaaggaattgatctaaagtactctggtgatttgccttgtataaatacagggagggcaaagcgtccaacatattttccaatcgaggtttgtttcagttttgttagtgtacatcctatcaaatctctgtttattaaatatatcttgcatctcatatttttgtattgtgttactagctatgctgccttgttccgcttcaaagatacaccaaagctttgtctacgctacaaaggtcatcccttgttgagaagtctagacagaagcctcaagaaaggatgacagttctaaacgatgtgagttgttaccttgattttagcatgctgcaacgatttataactgcatgggattggtttctatgactgaattaatcaacagcttatgattaccctaaatgctaggcactgcaacgcagtaactatgattctgaccccatgttgagggcatgtggcgtttcagttgctccaaaatttacccaagttgaaggaaggatccttcaagccccaaaggttggtgacacttctctaagctttagttgttttctcactaaatgttgtaccaaagcattatgtcagcaaaatgcatctgactaaatctaatatcttgtagctgaaagccggcaatggtgatgatatcttctcacgaaatggacggtggaatttcaccaatagggtcagcaactcagcatgtttcttttttaaccttctctagttcttggttaggaatgatctttcttctgatgtttatttgccaattctttgcccctttcagaagttttatcaaacctgctctgtggataagtgggcggttgttaatttctctgcacgttgtgatgttcggaatctcatccgtgacctgatgaggaatgcatctgcaaagggaattgtatgttttagcttttcacacatcttttattgtaacagttttctgttgcttaccttttcttctggcagcaaatggaggaaccttttgatgtgtttgaagagagcccctctatgaggcgtgcacccgtgtcgagaagagtggatgatatgtttgggcagataaaatcaaaacttcctggagctcctaggttcctcatgtgccttctccctgagaggaaaaattgcgaagtctatggttggtttatatttggttaccactgttactcctccatataaatatctcacacctttgcaataattatacctttttggtttcaaccaggtccttggaagagaaagtgcctggccgagtttggtattgtcacacagtgtctagctccaacaagagtcaatgatccgtacctgcttaatttgctgatgaagattaatgcaaaggtttgagacatgattttgtcttcttgtgcactgtattgttcactgatgcatgcttataccatcctttttcccctgttttaaccagcttggtggtctgaattcgttgctgcaagttgaagcatctccatcaataccccatgtgtcggaagtacccaccatcatcttgggtatggatgtgtctcatggccatccaggacaagataggccttcagttgcagccgtaagatgtgtataccttgtacaattcctctgcccacatggaatctgatgtaaccataactttcctctctgtttaggtggttagttctcgtcaatggcctcttatctctaaatatagagcatcagtgcacacccaatccgccagactagaaatgatgtcctccttgtttaagccacggggtactgatgatgatggcctcattaggtaagtaatatcttcttactatgtggatgtatataatatgtatgttaagcgtgatgacttttgaatactaagtttatcttcatatttgcgactttcagggaatcactgattgacttctacactagctctggcaagcgaaaaccagaccacattatcattttcaggtttgaagttttgtggttattatttgcttaatgcttatatcactaaatccttttgtagaaactaaaaaatattgggaagtatggtacattctttactggaatggattattgatactttcttaaccactgcagtgttaagtctaaccatttgctggttttagggatggagtcagcgaaagtcagtttacccaggtcatcaacattgaactggatcagataattgaggtaatgcatttgttttgatttgtccttgcacatttgcttagttcacaacgaatgccgtattccccacaaggtaaatactcctgattgcacattcttctaattaatgcaggcatgtaagtttcttgatgagaagtggtcacccaagttcactgtgattgttgctcaaaagaaccaccacaccaagttttttcagaccggatcaccagacaatgttcttcccggtaatgtttatttgtaacgaatttacaaattgacttaccgtttgcatgtgaattggcagtgtcctgtgagatgtggtgacaataaatgtgttattctgtaggaactgtcgtggacaataaagtttgccatcctaagaactttgacttctacatgtgtgcacatgctgggatgattgtaagtttgtgtctgatctctgaatgagcttgtccagagcaaaatgctgttagttacctctgaatcctagattgtttaagtgctaaataaatactggtatgtgcttgctgctcgtatcagggaacaacaaggccgacccattatcatgttctgcacgatgagataggtttctctgctgacgaaatgcaggagtttgttcattcgctctcttatgtgtaagtagtaaactttggttgctgcatttcactgtgactagttgctggctgtagtacctttgcttatgctgttgccgtgtcctgctatgcaggtatcaaaggagcacaacagccatctcagtaggtatgccacagaatcccagtttaccattgctgaatctgaagcattatttgcagcacagcagatttactctgtgtgcacgctttgtttgtgtttgcagttgctccaatctgctatgcccaccttgctgcagcccaggtgggcacgttcctgaaattcgaggagatgtcagacacgtcctccagccagggagggcatacctcggcgggcagtgctcccgtgccggagctgcctcgcctgcatgagaaagtgaggagttccatgttcttctgctgatgtgatggtccatcaggatctgggagcgtttgaactgattttggttagcggtagtgatgtgtatgtgtgtgtgtgtatggcatgcaaccagcttggaaccttgaaggctcgcttgttgtgccaacctgacttagctgctggatgcctgaatgtagaggcttttgtaggagaaccagtcagcagtccttgtgtatgcggtgttactgtcagcagctaacatcctagtaaagtttgtctgtggtgtaatgaaccttcacttgataaccttcacttgatgctagctaagctcccctatggatcgatgatgccttgtgctgtt

SEQ ID NO: 792 - DNA, 4124 bp, Sorghum bicolor
cgcgaatgccaagatctaggaggtgagcgttgagggcaagggcggggagtagatgcccatcaaattgggttcgctccaattccttcgatttgggcagacaagtccaactcgcatctggtgggaatatactacatgtgggttcgacctagacccaatgaacttcaaacaacactgaaaatgggtctaacccgctatacaaacgcatgcttagagcatctttaagagcctttctaaatttcactctctaaatcttcatttagagagtcacttgcataaaaaccgttttctatgtcttttcattctccaacagtctttctaaatctcatgcgtactctagagagtcattctcgttttctatttttagctagcgagaaattcggaatagaaaatgaccatatttggatagccatttagaaaagttgttggagagtagtttctttactaaaacctctattctcagtatttaaaataaatttagagagtatcttggagttcctaggagcctagcatgacccgctatcaaaattcaaggattctgatatgaggtgggtaaaaaaattaggtgagaattattatggatagattaattggtgactggtgcctagtagtgtcagtaataataatgaactactattactggtttcattttcacgtagttgagcaataatacaagtgcacctcttcattggccaggtgggtggtatccctgtcttcatgtcagtgagactaaataaactgaaacgacacagcacaaatgcaagaagaccagaaggcaacagccataataacgcggcagcgtctgtctatataaaagaagaggagggttttctggcttagcctggccaagaagaggagggggttttgcagaggaggagcaagaagtgggttttctggccttccgctgctgtcctcgagctccattttggtatgtaataccttcgccttcctgctcttgttcttcttcgtttctcgatctcacgcctcgccttccgttactacctcctgctgctcgggttgcttatatctcttatttttcttgttggagaaggcctggcctgatgcttgcatcttatgacacatgctgcgttctattgttggataaatatcatcccgtgagttggtgattttgggattgtggcttttcatatcctctgtggaatcttggcttaaatttgtggtgatgatcttgggtttgtagtttgttcccaagagtatcgaacagaaatgattggaaatgtgttgtcgttcctccatcctgtttttcttttttttttaaaaaaatcttattgtattttaactgtgtttagtaaacaattgcatactgctaatctgttttcccatatttggaagcagtaatcaagtttctcattcagtctaatgtgtgggaaaaaattagatggaattggtgcaatgcagaagctgtcccttgagatgagtggcggtcacttctatagttacaacattttgctgtgttttcattgcagacaaatctggcctaggatggaatccagcggtaccaaggatggcctcaacaaggcgccaattcttcagagactcccaatgtcgaggcctcatgggtctggcacaaaagggaaccaaatacggcttcgtacaaaccacttcaaagtctcagttcacaggactgatgtcatcttctaccactacaatgtgcgtgtggttctgatatcctaccttctgatctttttggaccctaaatcctctcttaatttcacacattgttccactttcaggtgagtgtgaagtatgaagatgataaaccagttgaatcgaaaggggtaagtagaacagtgatcgaaaagttgcaggaaatctatctggcaaatgtggactttgtttacgacggtgaaaacaacctatacacaatgtgtgcccttcagaatgtcgaggatgcgttcatggtagtagtggaggatggttcatctacaaagtaattattccaccttaactaaccttttctcatgttgtttatgatcttgagctaatctgtcattggttcaacaacttatcttggtttcaggagtgctaggagtaggacccctggaggaaatggaagtccagaaggaagtgacacaaaaagaatgaagcggcccatgacttgtaagacgtacaaagtggaattgaaatcagtgggagaattttgtaaagaaaaaaaatcagtgggagaaatcccattgagtgccattgacaaagtcctgagaggtcaagaatctgatgattgtcaggaagcccttcgggttcttgacatcatacttaggcaaaagtcagcgaaacagtaagtgatacctttttgataagactggttctttaaaacgattttgttaacaactgatgcaaaggtttgttaaatgtcaatctttttgtttctaccaatagcaagagctaaatatttttgttacatataaactccttgcttcactgaatctttgctctttttgtctgcacttcccaggggttgccttctagttaggcaatccttcttccatagcccttccgagcccattaagttgggtggtggtgttgtgcgatgtccaggatatcattccagctttcgacccactcaatctggactttcactcaacatcggtatgttttccacaggctgaatgatattacttgtaatcagatcattcctaaacagtctacgacaaagtgatagcacattacattcaacttttttcaactggtacagatgtgtctacgactatgattgtggaacctgggcctgtcattaattttatactgtccaaccagtatatcaaggaccctagcagaattgactggggcaaagtaagtcatggccttgatgcaactcatgttttcccccaataatgtggtagcccaagattgactactcgaccagattactccaatgctcagttgacttgtttttttaggcaaagcatgcattgaggaatttgaggatcaaaaccactcacactaactctgaattcaagatttccagcctgagtgagaagtcttgctatgaacagaagtgagacaattaaattcttggatttgatgttattcagcaaggccagctggaggttgtttaacatctaattcttgattcaggttcctgttgaagcaaagaaacggcaatggacccgatgtcgtggaaataacggtctatgattactacttgaagcattgggatataagactgcaggattctgctatttttccctgcttggttgttgggaagcccaagcgtccgacatatctaccgatagaggtctgtcgattttgtttcattaaaaaaattgtgccaatgcagtccaggtaaatcattcttgttttgtttgcgcataacactagaatctgtctacaattatcagctttgccatctagtgtcactgcaaaggtacacaaaggctctgactgtactacagcggtcctcgctggtccaaagttcgcggaagaaccctagagaaaggaagtcagatttgtctagtgtaagttcatttttttataacgaactggtagttagctctgcctttcaattaagatagggtaaagaggttcatggtgtaagttcatccatggacattattttgctcactgccatagcctagttcgattaacattttgactaataacatcattaccaggcactgcaacgcattaactataattcggatgacatactgaagaagtgtggcatttcaatagctccagagtttgctcaagttgacggtagaatccttcaagcgccaaaggttggccagaacttccctagttcccctttcttttttccaggctcttcggtgtgctgatgatgttgcacacttggttacggttgtcatgtgtagctaaaagctggggatggtcaagatcttattgcacgtgatgggaggtggaacttcatgaacagggtaagggtctcttctgactttagtccttagttccttacaatatcgcattaatcttttttgctgttgtgctaacaacaatgcccatattgtgccattcagaagctctttgaggccaagggagtgcacacatgggctgcagttaattttacgacaaggtggaagcttcaggatcttgttcggaggctcattcactgtggtgacaacaagggcattgtaggtctatgtttctaa

SEQ ID NO: 793 - DNA, 6184 bp, Sorghum bicolor
tcgaaatggaagcattgaaattcaaactgtggatatcactgttcacgattattttaagtccaagcaagttgaactaacgatgccttatctgccatgtcttgatgtgggaaaaccaaaacgccctaattatctcccaattgaggttgcaaccctgcttttgtttcagtctacattctacaatgtagtctggttatcataggtcccttttttagataaaggggttgtcatagtttctgactgcacttgatgtttgagttggtgccattaaaatttctattttgcagttatgccacatgttatcacttcaacgttatacaaaggcactgtcttctcaacaaagggcaacgttggttgaaaagtcgcgacagaaacctcaagaaagaatgcgagttgttacagatgtgggtaaattctgtcaatgttattactcctccctgctttctccccttaacttggtacttacagctaaaatgtgcaggctgtaaaaagtaatatgtatgatgatgatccaatcttatcttcctgtggtattgaaattgacaaacaacttactcgtgttgacgctcgtgttctctctgcaccaacggttagcctattttgccttttcttttcattatcacactttcgtatatgagtcatgttttttaattgtttggattgatatgctattcagctagttgtggggaacagtgaagactgcatcccgaacaggggcaggtggaactacaataataaggttgttactacactacttgtgagagaacacatttatctcagaacattgtgctgaacttcaccttttttttcattattgcagaggctattggatcccgtcaagattgagcgctgggctattgttaatttctctgctcgttgtgacatgagccgaatctcaagagagttgataaactgtggacgcagcaaaggcattgtaagtattttgtggtattttgttttcttgcatggtttgagggatgggatggcgatggatcatctcaagttctcaacctaacaaacttcgtttgaggaaccaccacaaacaaaagattagtataacatgaggaatggtgtgatccaaataaaatttgggattaccccatgatgggccacactatccttgttggggttgatcctgatccttaaaaccaaataccccacgaaagcttgaacatatttagcattcttattatgctgtgctttgaccgtacaagttatcccttgttttgtgcagctcattgaacgacctcacaccttggtggatgaggacagccagtctaggagatgttcacctgtggaaagggttgaaaagatgtttgaaaaagtcaaaacaagccttcccggtcctccagagtttctcctttgtgttttaccagagaggaagaattgtgatatttacggtaatacaatatacagttactgtttctatgctaccatgtatcctttatgcaactaaacttaaaatgccttgaagggccatggaagaagaaaaatcttcatgaaatgggtattgtcactcaatgcattgctcccagtaataagatgaatgatcaatatttcaccaatgttcttctgaaaattaatgctaaggtatacatttatcagcatctgatttgtgacccatatgatttgaacatagatcctgttattagttttctttcttgactaatatgatttttcctgtcgactagcttggtggaatgaactctaaactggcattggaacatcgtcaaatgataccagttgtgactcaaataccaacattaattcttggcatggatgtttcgcatggttctccaggtcgagcagatataccatcaattgctgcggtgtgtcttgttctctcttgtgttacttgcatcatgcgaagattggttttcacattacttttcatatacctatgtgcagtctagtttaattgaacagaaagcccaataatttgcaccatgtttagggaacaccaatatgaatgttatggcgaatgggctgaagtgttatggcgagtgtgttggttcttgccctggacttgctgcatcactgtctacgatagttcacggtttgttagtttgttcagatctgttagcagatagaattgatttgttacttggataagatttgttaggagttctgttaggtgtctagtttataaaggcagctgtgaggcatatgttaggcaaacgttctccctaatgctgatgtctccaggggctcccaggctcccctgtggttgcagccatctcagcctacaacccacatgcatgccatctctactgagcaccccacctgggacaaggctctggcgatttccactatggttgttcagcaagcagccttgttcttatccaacggatatatatctggttcatctaggggagtcaaagccaaccggcgctgtgggcttctttccatgggaacatgttttgctgggttgcttatcatttcagcctccagagaaggcctgaccttggcctgtggcaacacacatgccatgtttcatctgacccctgttatagtgcatccattgttacttgtgatcctttgtggcctgacgtgctgtatcagaagctgttttggtattagtttgttagcaggtaggtttaattagtgcaacatcctaccgcactggagacattccattcgtcaccttcggagctgcaagcacctacttcagcctatcacagcttaaggacgagctgtcttcgaagggtgctgaagtgttatggcacgtgggccggttctggccctggacatgttgtgtcacaacctaggattaggtcacggttagtttgttcagatttgttagcagatagaattgatttcttacttggataagatttgttaggtgcctagtctataaaggcagccgtgggcaggcagaaatagatctaagaagcagctcagagcctccagagggagggtgatttagtcgatctatctgctattcttgtatcccgttccccaatcaatctactacaacaatgagtttatgacactattctgaaaatttagagcactgttacagcttgctttcctagtttatgattgctggtttcaggtctctttttattgcctccccccatgtcaatttaggtaggggaagactgaaattgacatggggggaggcaataaaaagagatttgaaagttttggatatacctaaagacgtgttttcataggagtgcttggaaagcagctattgacgtccctgaactgtgattaggggctcttgttgggtttcaactctagcctaccccaacttgcttgggactgaaaggctttgttgttgttgttgtaataatactatgctaaagttttcctctgtaggttgtgggatctagatgctggccattgatatcacggtatagagcatcagtgcgtacccagtctccaaaggtagagatgattgattctctatttaaaccactggatgatgggaaggatgatggcataatgaggtgatttaaattaacatcttgtcagttttctgtgttatgttcttctagttgacctcacggtatcttcatgttgtatgaagtaatttttctcaggaagtggggccttagtctgttatctaaaagagaacaggaatggcctagtacccttttcactttttcattgcattgcagggaacttctactagacttctaccaaaccagccagcaaagaaagcctaagcagataatcatcttcaggtgtgtactgagttaatttttattttcagttatatatgcctatgattgtgtcatacaatgatataaaaggcgcatttgtttgcagtacgagtttgtaagagtgtgttggtgtgagcatggtgggtgtgctgtaatttatttgttatctccttaatgcaatgatatgcaactctcctgcatattctacaaaaaaaaagtgtcatacattgttaagctgtgctgaatgtgtacgtcaccattttttttctccaactcaaaggatcattattttagtgcaaactggaatgatttgttttcttgaatgatcatattttggtgattcaaaggaacatttggtctttccatgttaatttggttgtgttaatttagcataacatctagtaagatgtgtttgactccacagaattttaccaatcttaagccaggacaagtcaaatatctgtagctgatttagtatctctctagttattatcggtttcttttgtaataaaaagctatcatttcgtaccagcttttcttaaaattgtctctgcagttcttattgaagtgtgagctcttttgtgttaaaggatgaaaatcagtttatagttcagagttggctttactttgtgtgaattgaagttgatacacttcaataagaagttgatactcagagttgaaaattaaatgactcagagttgaaaattcagttggtgtcctttgattaaattactcaaattactcagagttactcaaattactcagagttgaaaattcagttggtgtcctttgattttccttttgagaattgaagttgatacacttcattaaatgaatgttatatttgagtaattttgtacagtatggttaattatatcatgtatgttcctttctatttattttgtggatgtgagggtgtctttgtggtttcttctttctgtattgatttgctttttttgttcctgcacgatgatctgggcattcactggtgctgtgacttttctagtgtttctgttcttggtattcagtgttgatgaattcttatccttatggtctacttatgcagggatggtgttagcgagtctcagtttagccaagtactgaacgttgagcttaatcaaatcataaaggttctgctatgcactgttttgcttgagaattccttggttttctggcatttcctaacaagagttagacaatacaggcatatcagagtatgggacagggggaccttccaaagttcacagtgatcattgctcaaaagaatcaccacacaaaactcttccaagctgattcaccagagaacgttccacctggtaagcacccttgtccggttgtcctgcttaatactgctaaagattcttcccctttaaacagcttgagcaacttgcactttgtctttgcatcagggactgttgtagactccggcattgttcatccaagacagtatgatttctacatgtgcgctcatgctggaccaattgtaagttctctagagtagttttggattttgcttgaccatgcttgttagtaattgcttaactggggatgtgtcagacatgtttcatattgagcactaccatgttctcttacatagggtacttcaaggccaacccattaccatgtgttgcttgatgagatcggcttctccgcagataatctccagaagctagttctttcactttcatatgtgtaagcacatatgttcatgtctatttccttatttcgtactcttatgtgaggataacatgtttgtgcttgtataggtaccagaggagcaccactgctatttctgtgggtacgttgatgttttcttttgtactaaaaaaacgtcacgcactgtttgatggttcttcctattttaggagacaatagatgctctctctctcctttttttctgaatgcagtttttgctttttcagtggcacctatctgttatgcccacctcgcagcagctcagatgggccagttcatgaaattcgaagagtttgcagatacatcgtcagggagtgtcaattcatcatcgtcagcatcaataccagaactgccacggctgcatgctgatgtctgcagttccatgttcttctgttgaggtgattttagtttgaccgttgtggggtagggctacttctttctgaaggagaaccttatatgttggtacacagcaggttaactgttttgtgaagaaaccaagtaggttgttagttgtcgcaaatcatgtacgccagcatattttggagcagttttgggctcccccccaccccaccccaaaatgtaggtacagcttccagattttaggtagcctggacgtttgcatctgcaggtttttcgattggaatctagaagattttagggatattgagagagtagagccagacctttgaggtgaaggatacttggttaaatgatctttctgttaatccccaaaatgcgtgtgcattgggggggtataaaaatgagttaaaatttctgtatctcgcatggcatccaattgtactcgagtgtttgtgctgtac

SEQ ID NO: 794 - DNA, 10803 bp, Sorghum bicolor
gatgaaaacaaaaactaactacacagtttgctcgtaaatcacgagacaaatcttttaaacctagttactccatgattagacaatgtttgtcaaataaatacgaaaatgctatagtgtcaaaatctaaaattttttgatctaaggccttgtttagttccgaaacttttttggatttcgatactgtagcatttttgtttttatttgataaatattatccaatcatggactaactaggctcaaaagatttatctcattattttacaggtaaactgtgcttttagtttttttgttttcgtttatatttaaagctccatacatacgctgcacctgcaagattcgatgtgacagagaaccttaaaaagtttttaatttttggatgaactaaataaggcctcggtgacaaacacacacccccaacccctacccccaccccacccaaaaaacaaattgaggccttgtttagttcccaaaaaatttcaagattccccgtcacatcgaatcttgtggcacatgcatgaagtattaaatatagacaaaaacaaatactgattacacagtttacctgtaattcgcgagctgaatcttttgagtctagttagtgcatgattggataatatttgtcacaaacaaacgaaagtgctacagtagccaaaaccaaaaatttccctcaactgaacaaggcctgaaactctggcccacactcagttccatcaccactccagccacccccaccatatatagggccttgtttagacgcgaaaagattttggatttcgctactgtagcactttcgtttgtttgtggcaaatattatttaattatggactaactaggatcaaaagattcgtcttgtgatttacaggtaaactgtgcaattagtttttatttttgtttatatttaatgctttatgcaagtgatgaaagattcgatgtgacggaaaatcttgaaaactttttgttttttggggtgaagtaaacaaagcctaggtcttgtttagattcaaaaagtttttagattttaatactatagtatttttgtttttatttgacaaacgttatctaattatagagtaactagacttaaaagattcgtctcatgatttacagataaactgtgtaattaatttttgtttttatttattttaatatttaatacatgtggtgtaaaatttaatgtgacgaagaattttattttttttagtttttgggtaaactaaggccacagccgggtcatgtggcagagacaggggtggaggggccaaaggccgaaagctgccaaccctcgcctcgcgggtgaggagcgaaaattcgaatccataccctcccgctcccgctccctcgaacttttgggtttcgttttccctccgccccccgcccgaccgccgcgtccgctctgccctgttttcacgttcgatccccttcgattcgatttctacacccccagagtccagactccagagctctcactctcctgccaaaccccctcgtctcgcccctgccatggcaccgagctccccgtcccccgccgcgcccacgcgtgtctccggccggaagcgtgccgccaaggcagaggagatccaggaggaggaggttgtggtggcgtcctccgccaagcgcagccgcaaggcgccgtcttccggcaagaagcccaagccgacgcccaagcaggccaaaccggccaaggcggcgaggaagaagaagggggaggccgagaggaaggagcccgtggaggacgacgtgtgtgccgaggagcccgatgaggaggagctggccatgggcgaggaggaggcggaggcggcggccgatgagcaggccatgcaggaggaggtggccgcggtcgtggccgggtcgcccgggaagaagagggtggggagaaggagcgccgccgctggcggcgaccacgagccggagttcgtcggcaacgccgttcccgcggccgaggcgcgcagcaactggcctaagcgctacgagcgcagcactgccgcaaagaagtattttttccctccctactctgctttgcttttgattcgaccccagatgtttgcttccctgttgtgacttgtgagctgagcaatccctgtttgttgattcatggcttgtgcagaccggaggaggacgaagagctcaatgccaagtgccactaccggagcgccaaggtggacaacgtcgtctactgcctcggggatgacgtctatgtcaaggtccttgttcattgctttcattgccttctttatttgccatgatgctgttgctgctctcgtttatgctctgctcatgtttttgttaaggaaggacttgtttgatttttattgtccatttccaatgacgagttgtgcgtatgatcagcagtacatggtggcacgctggaagtctgtatggacaaaatactgtcttggtagcatgtttggcttcgaccaggaccttgcttaggaccttagtagctgcttgggtgctttttgcagcaagcttggcaatgatgaccaagtttggccgcttattagtttagttgtttggttgttttttcatctaagtgtaagttatgctctgtgacggtataattgttactgtgatcatataattgtcatggaaggaagcattgaactttaaaatcaagtcctagtgatgtgtgtttaacaagtggtttatggtcaattctatcttaattttggtggcttggtcattctggaatcatcacaatcgctccgtgtttgatgggattacccctagcctgaatggtgttttgtcgctcattaaagaggagatacttctatggagtctggttggggctagaggaatttctcatctcctctctctagtgacaagtgcaaactaggactctttctcggtcgaggtcaagcgttttttgatgtaataggcgagcagtggtttcttgagtgaggtgcggtgtgttgttgttttaggttatggggttttacacccctttcttcttaatatataaaacaagtggtttatggtattacttcctctggtcatgagtagaacaagatttggtcaaaccttcaaaactacaaacatcaataagtattccacatacttgcaaatctcttatatcggaagggttataatattatattctaaaagaaattagtggtcaaagatatgcatggaagattgcaaggtcaaatatcaaatgtgtgaagtatctgtgagagggagtataacataaggggtgctctaaatgtctgtctctacacaatgctgtgtttggtgtatatcctgctcctaaaagttggatccttttgattctgttgaaaatgaactgttcaacaatttcaatgctactaaatgttctaatgtttttgaggaaaaagtgttctaatgttaagaggatgttatttttaataacaaaaatgctgtttaaccctgcatctattttgcatgtgcggttgtgctagtgattgcttacatcatgttatgatctctgacattatttgaaaactttcttgtcttatttgcctgtctatgagagcctgagagggaagtattgtttgtctcttaaactttactttcatgaaagttcttattaattcaactgtacataaatactgatgatgcaatgaacaagagtgctcaaactaatggttgtgtacaataccactggatgattttgctctcacatcaaatctttttatatgttctttaataatagttagttagttactgaccttaagtttatgattgctttttgcatattttaggctggagaaaatgaggcagattacattggccgcattactgaattttttgaagggactgatcggtgtcactattttacttgccgttggttcttccgtgcagaggatacggtgcgtattgagctttgtgtcatttctaatcattcatgtcaagaagtagcataaaactgaaccctatcagtgcaggttatcaattctttggtgtccattaatgttgatggccacaagcatgaccctagacgtgtttttctttctgaggaaaagaatgacaatgtgcttgattgcatcatctccaaggtcaagatagtccatgtggatccaaatgtaagtcccctgatgagagctttatggttttgctatgcacataatgtttctcactctaactgttttttttgccttagatggatccaaaagccaaggctcagctgatagagcattgtgacctatactatgacatgtcgtactctgttgcatattctacatttgctaatatctcatcaggtaattgcttctacatcatccttttttggttgactagctgaatgcaatttacttgctttgctaaattagtgcaacgatactactcagggggtgtttggatgcatggactaaagtttaacagatgtcacatcaaatgaattaattaagtctaattaatctatcattagcaaatgtttactgtagcaccacattgtcaaatcatggactaattaagcttaaaaaattcatctcgcaaattagtcgcaatctgtgcaattagttatttttttagtctattggtttggtcatgtccaaaggagaccttatgaggcatagtcaaggttcagctaggcgctaggcgtaatcggggcgctgacccattgcctagcgcctagtcgggagtactcggtcctaggcgctcctaggcgttttcctaggcgttttggcaatataagccataaattatatatattatatatatatatttatatataactactatatatgagttacaactaatgtgcatgctactgaacaaagagcaaagagcaaagaggggagatgagcaggggaggagctgggagggaagggagctcaccttggggacttggaggagcaggggaggagcaggaccgacggaggaggagcaggaccagcggggggcgcctcggggattagcaggggaggagattggaggagcaggggaggagaagatgaggagcagaggaggagcaggacctgcagggaggtcgcccggcgacgaggaccggcggcagggacgaccaaatctgactcggggacgagtgaatgacgccgcgctcccttctattcctcccgcgccttcgtttcatggccgcgcgggaaatcctcccgctctccgatttagcgcgctaaattggccgcgcttgcgcccgcccagcgccgactccgcgccgcccagcgcctcgaagcgcgactatggccatagtcgaggcgacgggcttcgcctagcgcctaatcgccgcctactcgacgcctagccgaaccttgggcatagtgcattgtggagtcctaagtcgagatatcaatgtgaggagaggtagaggaagactgaagctgacatggggggaggcaataaaaagacatttaaagggttggaatatacctagagatctttgtttagataggagtgcttggaaagcagctatcgatgtccctaaaaaagatatttattcattcaaaagctattctgcaaaaacaattttgaaaagtaaaagctcaaacaacatgcctgtactccatcctaggtttattgggttaactttgattagtgcatgcagtgttgaaatataagtgaattacccacctttgcctaacaggtcaaacttttggtttgaattggttggtgcatgcaactcaatactcaatatggtattagtgctagaggtgagaagtctcgagtttgaatcttggctagtgcaattaaataaaataaatatagttgacctctatttccataatatttgaggcatgagtgactgagcctgccagggagggagcagtgttttctgatcgtccgattaatcgcgattaatcatccttatcggtctgtagcacttgattagggcctccgattcgattagagcgattaaaaacctgatcttccgattaatcgtcgattaatcatgattaatcgtcttgattagggtctgtagcacttgattaggcttttggcctgggatatatttaactgggtcaggcccattagggttttccttataacttcacccccactctcttctcagtcctcactcccactccagccgtcagctactgagttgctgctcctgctcgtgctgcttgctgcttcctcctccctcttccctgctgcctggtgcttcctcctccctcttccctgttgcctgcttcttcctccccattccagctccaatccaagtagcccgctactgcttgcttcctcctcactcttccctgctgcctgcttcttcctcccccttgaccttgatgcttgatgtccatatataaatatatagagtcaaatctcacaggtaagtagccaactaactagaaatatagtcttgatgcttgatgtgtactatataaatattgggagggagagtgttgaagtataaatgagctgtccacctttggcaaaagtggtgggatcacggcctgatcttgtgccaaaattaacactatgttgtaatggattgaaatgagctccaacatggctcatgatgcctaatagaaccattgtgtgcgacggggaagactttcagcatgtgatatattcagcgtgaatcatggcctgatattgcgtcaaagatgatcacccaaccgtatgaatgatgcattgctggttggtcgccatcctttgtgactttcttgtggaagtagagtgccattgccttcaactctctgctccttgcttcatttgcctttctatgtctggcttttgcaagcctgcccaataatcaagaaaggagcacatcatatagataatcttagagggggatttggttcttttgtcctcaaaacaaacaacatttcttgtgcaccatattgcttgacacagctgccagcctcactgcatataccagtttaccattcggtaaacaaagcttgatccaaacccaaaactgatcattattacaaggtttgcaactgactccaagggcacagcaatcagaatcaaaatgtatttcactgtcatccatccatccaacaaagagatgttccactgattccttttctgtttaaaaggcatatactgtatttcgcttcctttccaatttctcctcgtgaggttgtccttagtaaggatagtattttgaagaagccacacaaatattttaattttcagagggattttggattgccaaatatgtttaaaattttgaccttgatcattttaacataaatgtttatacactgatttgttatctacttctattttacgtgagggggagcttccatgtgataggtattaaatataactgaattgcgcaattccttatcagcttaggcttgtgagtgcaatggttggtgtatgtagctcaataactaaaactggtttgaacagtctacaatgattaactttgatactgcctctgtcccaaaatagaagtcagcttttcttaactttcactaactatatataaaaaatattaatatttataatacataattagtatcattagatagatcgttaaatatttggagatataaatgttgcacgtattttctacaaatctagtcaaacttgagaaagtacttgttaaaagtttatgtttttttacaaaccctgacacttgttttttactagaaaatgggcagtcaggtagtgaaaccgcttcgggtatttcttctgatgatgtggatctggaggcgccatctagtatgccagagaggacagcaacccttcttgatctgtattctggctgtgggggcatgtccactggtctttgcttgggtgcagctctttctggcttgaaacttgaaactgtaatcttctacctatttatctgttggatagaatgtgttcatggtctcagcactaattctattgttctggctatgatttgcagcgatgggctgttgatcttaacagttttgcgtgccaaagtttgaagtacaatcatccccagactgaagtatggatagtaaactgcatcttggatattccatctgttttgtccagctgctctcacaaagttcctttggatctttgaatgtaggtgcgaaatgagaaagccgatgagtttcttgctctcctcaaggaatgggcagtcctatgtgagaaatatgtccatcaagatgtggattcgaatttagcaggttcagaggatcaagaggatgaaggcagccctcttgacaaggacgaatttgttgtagagaagcttattggaatatgctatggtggtagtggaaggaaagatggcatctattttaaggtacttaacgttgtctgttcatctgtacttgataccaagaaaaaaagttcaattactatggcaatatagaaaaaactaagcttttcaagcaatggatatttctgtgtgttttgttgtaatgctagatttctgcaggtccagtgggaaggatatggtcctgaagaggatacatgggaaccgattgataacctgaggttcgtatttggtatgtcatctgcttgttgccttgtacatctgtttgcactctaatccttgtttcacaaaccagtgactgcccgctgaaaattagagagtttgtacaagaagggcacagaagaagaattctcccgctgcctgtgagtatttagttgggtgtggttttcctccctgtttgtttagttccccattttcatttggtgatatctacctaatctattctttcaaaagggtgatgttgatgtcatatgtggaggtccaccatgtcaaggtatcagtgggtttaatcggttcagaaaccgtgatgagccacttaaagatgagaaaaacaagcaaatggtgactttcatggatattgtggcttacttgaagcccaagtatgttctcatggaaaatgttgtagacatactcaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtttgtttcttaccttgatgttttatatgctttgttacatttatattgcactgttgactgctggctaatcagttgtatttgacaatgtaggtgctccctaagtatcctctgcctacatatgatgttgtagtacgtggaaacaccccaaatgccttttcggtaagtgcaatcactactttgaaatcctttggaatgtgtaaaatctgttgaccaactgaattgtttacagcaatgtatggttgcatatgatgagaaacaaaaaccacacctgaagaaagctttgcttcttggtgatgcaatttcagatttaccaaaggcaagtgttttctcaagttcatacatttctcaatgtgcatgcaatcttactcttctctgcaggttgaaaaccatcaacctaaagaggtaatggagtatggtggttcccccaagacggaattccagcgttacattcgacttagtcgtaaaggtaagggccagtgagctttactggttgactttctccatgaatttcagaagaaccaccttttttttcttggtcctttgctaaattgctactactgcagcaagttcactctgttttattctttcagacatgttggattggtcctttggtgaggaggctggtccagacaaaggcaagctcttggatcaccagcccttacggcttaataacgatgattatgagcgggttcaacaaattcctgtcaagaaggttggtggcttgatagtgtttgtgccttcctttgttgttcctgaaataatcacactctttccaatgacagggagccaacttccgtgacctaaagggtgtcaaggttggagcaaacaatattgttgagtgggatccagaaatcgagcgtgtgaaactttcatctgggaaaccactggtatgtgttatttcgtgctgttgtttccataaagtgcaacatttatgttacatattcagactcatatctgatgagatgctgcaactactgtaagattcatggttaagacatgataagattttgcacaaatctttgttatctaggttcctgactatgcgatgtcattcatcaagggtaaatcactcaagtaagttacaaaatggtcccgctttctttctttctttgttttttttgaaaaaaataggttattggttacttgtccttacatatgttgttgtaggccatttggacgcctgtggtgggatgagacagttcctacagttgtaaccagagcagagcctcacaaccaggtcagcttcagtacaaactacccctttatgataatccctgcaactgtctttactgctagtgttgtctgcatatgatcctgatcgaatatgttgttatcagattatattgcacccctttatgataatccctgcaactgtctttactgctagtgttgtctgcatatgatcctgatggaatatgttgttgtcagattatattgcatccgactcaagcaagagtcctgactatccgggagaacgcaaggttgcagggcttccctgattactaccgattgtttggccccatcaaggagaagtaagttcctcttttcagtttgcctgtacgtgatctagtcactcttgaaagttgtcagcagtaaaccattgaacagtcagtttcagctcttgaaatcagaagcaggattatgctgcattgtaatccttgcctctgaacatgcgtgctttctctgatggtgataggtatattcaagttggaaatgcagtagctgtccctgttgcccgggcactgggctactgtctggggcaagcctacctgggcgaatctgaggggagtcaccctctgtaccagctgcctccaagtttcaccgctttggggcgaactgcggtgcaggcgagggcctctcctgttggcactcctgtaggggaggttgttgagcagtaa

SEQ ID NO: 795 - DNA, 12329 bp, Sorghum bicolor
gcttgggatggaagtaacaactctggaggcaagaagcgccaacgatttcgaaagaagtcaaagtgaagatgctctaggatttacattttttccatagggatatagctttctatgttcaaggacttgtgaacatagtaaaggtgtaggcatagaaagttgccgtgttacatagttgtatttcagcagccggtaccctaaagtaaattgcccggtcctgctgtatatattgccaatcatggataggagacatgaatgacatcataatggactaaaggagacatgttatgtctgttccttgatattagtagtattattctggaaacagaattgcatgtcatacaaatcttgaaagcttgtggtaactaaggttaggtagaatagccaggggcataatagctaattttaactcttctctcccctccactcgtgaaaactattatttagatagtcatagtgtctaagagctaattaccacaattacaaaatgtcttctagcaaaaacaaacaatattattaagtaaatgtttcttaacaaaaaactaacattgaatgataaccaccattgaacaatgtcctataacaaatttacccttaacaatttggcactcctcccaatggcccctgagtacagtgtgttcgtatttggttgcttttatgcaggctttacgtagtgcttaaagcaggtacaatgtcgcttcatagcgagtacgttagatttagtcatatgatacaatgcagatttacataagctgacgtgcacataaaaaaataaaacattatcatttacatacctctagtagaaatatgagacctcaatgaatatgattatatgcaacaaaatgtacacaatcacacataattttatcaaatacgctttgcttgtatagaacaaccaaatatcaagacactatgtacttttagcttgacttagatttatacttataagatctaatgcaagctaaagctaataaaagattagaagcaaccaatcagatttcaagtgaatggacgcagagcatcccgttacaaacagaagagcatcggttctgttgaggaaaactaaaacacaagaacggaggagaggttcatcacgacggtattaggctgaggcgaaaccatttgccaacaaagacatttcgcacgaacgtgccacctgacattatgggtccacgcgccagccgcccatcagcgggaacccgtccgtaccgcctccgcaacggtaacgatagcggtcgcctgctccccagaacgcaaaaacaccccgccgccgccccggggcccctccaaggctccaacgaacgaacacaggccacggcgccaccgccacccacacccaccgcctcacgcacttcgccttctcctcgcagctcagctcccctctctccccccattccgccgtgccgtgcctctcgcctcccggcactgccgatttatataccaaccaccgcgccatgcgctccccaccgccaccgccacagccactccacccgcaccgaaccaatggcggccgacccgccgcccccacctcctccggcgcagctcccgcctcctcgccgcccgcacaagcagcttcagccgcgggggtactgatcgactctgatctcgcgctgtgcggccgtgtggcgggggcctgatgagctgatgtgtaggttccgctcgcgtcgcgtgtgcaggtaccaggtggaggtgttcgccgcggcgctgcgcgggaacaccatcgcggtgctagacacaggctccgggaagaccatggtcgccatcatgctcgcgcgggagcacgtcctccgtgcgcgcgctggggagacgccacgccggatcgtggtgttcctcgcgcccactgtacatctcgtccaccaggttggcctccggtggcccgttttgtcttctccacgcgggaatgtggtgggtagaggctgtgtttttgatgggggaagcggtgcctttctgtgtttgtgctgtagcaattcgaggtgattcgggagtacacagacctcgacgcggtggagtgccatggggcatcgggggttggcgactggaacgccaagcgctggaaggaagcaattggcagtaaggaggtaagcgccagggttcactgaagcctgccctatgcttgacacagtaattgagcaattgtgatgcactctgagatttactaccaacttacttgactaatggcctggaacatcaagcgtcctgtagtgttgataaccactgccgtcagtcgtggtcgtcctgagttgaatgtagattgaggttattttcttcataaatgcaggagttcttgactaaaattattcttcaataatagctatatacatatgaaatattctccttgtttccgttgctatacggatacttctctacattcacaaaatctcataatccttgtaaatatgccactgtgatgaacttatctgaacttatatggctttttaattttattttcttctcttggatttcatagtcattcatacgattgtgaaatatgtaagcaatgactcttttccttttttttcctctcagattgttgttatgacaccacagatattattggacgctctcaggcatgcttttctaacaatgtgtgtgatgagcttgctaatatttgatgaatgccatcgtgcttgtgggaaccatccatactcaagaataatgaaggtaacacgatttgaagatcgtttctttggtttgacttgtatttccgataggctttgttccatactctcttgcagtcttgtatagtacatggattgcttaggccttaggatcacgttttctaaacaagtgtcatgcaaaagttctaatgtctctaacccggcttgtgtttaaaggagttttacattgattctgagtggaggccagctatatttggaatgacggcatctccagtttctaaaaggggtaggagtttctgtttatgacattcatgtgtaatttctcttttgtcaatcgttccagcaattattctttattgctattttaattatcatgttgtatgactgtaattgtcttcctttttttttgtcatactccatgaaaaactctttttgataaattttatggtgcattgatactccattttggtgtataacactttttttttctgatatcgactcatgttgttttgtgcatcataagacaatgcattttgggagtgtggtgctctcttgtactaaatactaatgctgctctacttctcagaagtataaatttctaggttatctagcttacatgatttgttgcagctttaatttttttaatgattttgtgcatctaatttgattcttgggtgcacattgcacttccttgttaattgtttttcattgttactattcatcctactggaagctacatatatgactaatttactgagtcaaagttgtttctgatctatgactgtttcattaggcatatgtttttcttactaattatggtaggttcacatttttggatccttagctattatttgggtagggtcatgcagagtgtagcacaggagccctattagaatatattgtcaccttggattcacattcctaccattaaatgtgccatgctattctattttgcatttagtatttatttctaaaaccttatatttttacaggggcttctactatagaagattgtgaagcacagattgctcaacttgagctagtattgaatgccaaggttctttctctcttgctgccaaaatttccttaaattttttattgagttcttttaggaaacccaagtttgcagcagcaaactgatttaaatatcttacacattatcccaggtatatattgttgaagataggaatgaacttgagagcttttcaactggtgcgaaaattgtgaataaatactatgatccttacttatttgatttggatgatctggaatcaaagttacagatgctgttcgaggaggtgatttaaccaaccaactatatttcttctgattcactagaaaaatgtgcttttttagtagccacagtctcgatacctagtatctttttctgcttgtacttacgcatatgtttatatatctaaacattgtactgttgggcagtttgatggtttgttggttagtctacaagaatcatctcctaataaatttgaagacaccgatagtatattggagatgtcgagaaagagcttgtccaggtaccatgggaagatattgtacggactaaatactcttggtccaattgttaccttggaggtattattttattgaagcagcaagtatttcttttttttttctgaagggttataatgtccattacattctatttattgatattgattagtagctgcataagttcgtgtgtccttaatgactcctacatttctacacatttgttaactaatgccattgactcttgctgagacagggaatatattggattaagaaattggcaagcataatttaataggtcacctttgttataggaaacacatttgagataccctttctcttgtctcacaaaagaaaaaatggctcaactcagtgaatacatttgccctcctttatgaaaattttctgtttctttccctgccagtcttaataatgtagcacttgcactgcaaaccatattacagtaccataccatttgtattagaaaatatgtggtcatgatcctatgttccgaacattcacctgtagctttcatttctttagattgttttttcagtttgaaggattatgttcttcgttcctagaaaatcatacatgtatttatatagcaatcttattaaccagagtaactaattgtacaatttgaatgcttatatgctaactctttattacatttctctgacaggtggtgaaaatatataatgaaagcattaataccgtaggtgattctgaagattgtctattttctaaagcaagcctcaacttacaggtgtcctatttcaaagaagctttatttttgattgaagaatttttgccacagggtatgatgcactattttacttaactcttactatactgtcaccagctttgaacctacagcttttatgcatcaatatttactttctaattcttatggcatcattctataataggttatggggagctgatgaaatcagaatctggttctgcggaactaactaagaggggatatgtttcttctaaagtgcagacactgatcaacattttcaaatcatttgggtaataccttaatccacttaagatgtttatttattcctttgtttagtcttctgttcgtgcaaacatacatttacatgtgttttctccacagctcgtcagaggaagtgctttgcatgatttttgtagaaagaattatgacagccaaagctgttgaaaggtttatgagaggaaatgtgaacttctctcgtttttcaatttcatacttgactggagggagtacatcaaaagattctttgagcccagcagtacagagatttactttggatttgttccgagctgggaaggtattatgttttacatgtgaaatttgattggaatattcaaatgatatactaacccttatttcaatttataggtgaatttgctttttacaacagatgtcactgaagagggtattgatgtacctaactgttcctgtgtgatacgctttgacttacccagaactgtttgtagctatgtccagtctcgtgggcgtgccagaagaagcagttcaagttatgttcttatgattgaaaggtacaaagtttgctatatttaatcaattttattttgatatggactgtttaactataaaaaagtttatatggtcaccaatattttgtcccgttccaagttacacctattcttaaaccttttcttatatgctttgtctggaactttcaggggtaacttggtgcagcaggaacacatatttcgtataatacgaactgaatactatgttaaaaccttcgcactgcataaacagccaaatactccatcacttgatttgcctctccaagagaagtacatgtaccatgttgaatcaacaggagcaactatcactgcagaatgctgtgtcaatctaatttataaatattgtgagaagcttcctaaagataggtatgcttgtgcttttaatctgcatatgtgttcgttgatctgcatttcaacatatgtgtgattgctattcttaaactttcaattggatttgttcctgctatgggtagtatttgcatgtgggctgaaaagttgatcaaacttaaatgtcacacataatggaataactacacctcctaccccatgaacttgctgtataaaaacacgatagcactcctctccaggtattacttgccaaagccttgctttgaggtgggtctcaaagatgggtcatatcaatgtgccttgacaatgccccccaatgctgcatttcgaagtatagttggtcctccaagcagtacatgtaatttagccaagcagcttgtatgcctcgaggcatgcaagaaactgcacgagctgggagaactcgatgatcatctagtacccttgactgaagagcctatggatatcgatacagacacaacagataaaaaatgtgtttctggaccaggtatggttctaatgttttgcaagtgttgcttcgtgcttacatcaatgtttcattgagaggaacacctcttcatatatttatctctgtttcaacaataaaatactgtacagtgagtgagtctgtttatagtggttgtgactcagaacgggcatgaaacttctgcataccaggatagaacttgatgagctagtggtggttgaatctgtttgttgccttgcatgctgcatcatatttacttgtacagaaactctcttcgtataagttgttatctttgtggacttgtttattaagaaaatgtctcatttgttatttttgacatggattgagcaatgcactgaatacttagtttacaaatggaagttgacagtagcattcccatgaagtattagcaacagctatgagtgcttctccttccgaagaagattttatattttttccattgccctttcaccattttggcaggaacaactaaacgaaaggagcttcatggaataataaatgttcatggtctatctggaaactggatccatgaaagtgaaactgtcattctgaattcttacacatttgattttcgttgtgatcaagaaggtgaaacttttgctgggttcgttctcttaatggaatcagtacttgatgatgacgtggcacattcagaaatagatctcttccttatacctaataaaatggtgtacaccgccataactccttgtggaaaaattcaactgaacaaagagcaggttgttcaagaaaccctgttgctagaattcttttaagtttaccaatggcttacttttcctagttttcttcagctgcgtaaaggaaaattattccaagaattcttcttcaatggtatatttggtagattatttcatggttcccgaacgagtggactgcaaagggaatttattttcagaaaaggtcatgaaatacaatggggctcagacaacatgtacttacttttgcctttgaggaactcttcacatatacagcatgatctgaacatatactgggaagccgttgagtcttgctctggtgcagtggagcagttgagaaatttgtatctagaagatggaaatcttaaccatgaaaacttatgttcacataaaagaagcaacaagggagaagacatcattcatctggccaataaatctcttcatttttccacagtcaaagattcagttgtgctgtctcttcatactgggaggatctattctgtccttgacttgattttagatacaactgcagacgactcattcgatgagatgtataatgggaaagcttcaccattttcttcattcgtggactattaccatcaaaagtaggtgctcatttttaattttctcaattcaagaattgatccactctgttatgcttgctcactaatttctctgttctcacctatatgtaggtatggtattgttattcaacatccagggcaacctttgttgctgttaaagcaaagtcacaatgcacacaatttacttttttcaaaaatgaaataccaaggtactttaacctcaatgtagtagcattctttcccttctctgttgtataatttgagactagtaattgtgttactttggctctgcttttacatgacactatccaatttatggcagatggttcaactggcaatcctctgctcgtggaaaaagagcaaattcatgcccgagtcccacctgaactactcatccacattgatgtcacaactgatattctcaaatcattttacttgctcccttctgtaatgcatcgggttcagtctttaatgttagccagccagcttcgcagagacattagttacactcaacgcataccaagttctctggtttgttctctcttatgatattacgtattgttttatttgttaaggatagtaatgctaatgcatatatcagaaatctgacttctcttcatgctagattttggaagctataacaactttaaggtgctgcgagaccttttctctggagcggttggagttattaggagactcagtactgaaatatgtaataggatgtgacctgttcctaagatatccaatgaaacatgaaggccatctctctgatatgagatccaaggcggtatgcaatgcgacactgcataaacatggaatatgccgatccctgcaggtagatgttttcaagcctaagtccatttgtgtgatgtcattttgctgaagttcataattggatctgtcaatattctttacatcataattcaaccagttttgtgtgacagtgacaccaattattccttgtcatcatttgacaaaagttgacattttccagaaggtttagtccagaaggaataagatgcatgctattcatgctacaatggatagacgaatccagttacactttttcctgttctgtgctacccatctgtagtttcatatcttttttgagaatgtgcatagcatgtgtttcattaagaagaagttagaaggtttacacgcccaaaatcacatcacggcgaggtgccatgaacgaaggggtagaacacgaacacaaggcgccacagggtggtgaagcacacgctgttgtaactaagaaactaaaggtgcgacctaagagcttgcgacgttgagggaacccgtagtttcatataataagcctaatcactggtgtcatcttttctttgaagtatttcctttttattagtttttttatttaatgtatatctattaatgctttcagggttatatacgtgatactgcattcgaccctcgtcgttgggttgctcctggacagatatcattgcgcccttttccttgtaactgtggaatcgaaactgcatttgttccttttactggagaatatatcagtgatgatccatcttttattgtgggaaaaccatgtgacagaggccacagatggatgtgctcaaaaacagtatctgattgtgttgaagcactagttggagcatattatgttggtggtggcatcactgctgcaatttgggttatgaggtggtttggtattgatgtcagatgtgatatggaactagtgcagaaagcaaaatataattctaatgcatctcaattgtgctatttatcaaaattaaaagtttttgaggaactggaagcaaaactgaagtacaacttctcggtgaaaggccttctgcttgaagccgtatcacatccatctctacaggaattaggagttgactattgttaccaggtcagtgaaacagagttttagtacattagattattgcatttaaggcacgttgatatacatatcttaatttctgatttgtaacagcggctggaatttcttggtgattctgtgctggatctattaatcacacaacatctctatgctacccacactgatgttgatcctggagaattaacagacttgcgttcagctttggttagtaatgagaattttgcacaagcagttgtaagaaacaatattcatagtcatctacagcatggatctggaatacttttggagcaagtaacagaatatgtcaggtccagtttggagtaccatggtaaagagaatgaattcgttcaacaagctacatttaaagcacctaaggttagaaaacttagttctacttctgtttgtggcttaacagcttattttactttattgtctttttatatctttgagggaataacatggagctctccttcatattcccaattaataattgtgctttcattgtttgtgcaatgtttatctcttttactcagcaaagtagaactttccaaggccaacagtatggacacaaattagaaagctaattttaatttccttgaacaggttcttggagacatcatggaaagtattactggtgcaatatttatagatgtaaattttaacgttgatctggtttggaagattgttgaaccgttactttctccaatgattacccctgataagcttgcattgccaccttatcgggagttgctggagttatgtagtcaccttggttgcttcataaagtcaaaatgtactagtaaaggagaagaattaattatagagatgacggtgcagctgcgagatgaactgctgatagcacaaggacatgacagaaataggaaaagtgcaaaggcaaaggcagcagcccgaattttggtcgacctgaaggtatatcttttcaaatagaaacaaaaatatcaagaaattgtctagttcaaggggttgggcaggtccattgtgatgctaatgggtaacccaactacacaccttgggtgtaactttctattctattgtaatggttgctttggcagtagatgctactccttcctgtcggaaatccatgatggttccatccggtggcttgaactataggcaaaatttgcctctcgagtgtcatgtattttcagaaggatggagtatgttttgttgactattctagaactggttttaatttttgttctgaatgcagaaacggggtctttctcttaaacaatgtttctctaaggctaagcaattggatattgtctcttcagaactgcaatcagaattgataagtgtaagcttctagagagttttccacaaaatggcacatcaaagtagtgaactcaattctgatgctctgagtaatgaatattatcgcatctatgtagttggaatcacgatatgattgtcctgacgtgaatggcagtcttagcctagaaggtctttcctcggtgagagcagcaggtaatgccctgttttggttattactccctctgttccaaattatagttcactttagttttatacttttatgtcctaagttaaacttttctaactttgaccaagtttatagaaaaatacatgaacattacaacatcaagttagtttcattaaattttccatgaaatatattttcatagtacatttacttgaacttgaggtgttgatatatttttattaaaacttcttcaaagttagggaagtttgaattaggacaaagctagagtgaactatgatttggaatgaatggagtatatggtactcactggccaggctatcaaataggaaatattagtcattagattttttttgaagcaaattagtaattagatttattctgtatagttctagcagccacaaaatacttagcagtactcagatgccatggcctttcatatgctttcagttgttcttcctctcaaaatggataaaggtggacctcggactgcactttttaggctatgcaagagattgcagtggccaattccagaatttgaatttgtggaacaaaggttcaggtatgtcaaataatacccaaacattatttttcttgtaaaagaatgtgaaacttcattcacaagagctttgatgattcttattcatttggtcttcaggaacttttttttatctttctatgtcttttacatttaagaatcatggttcaaacaagactaccttcagaaaatcagctggtttagtgttcatatatatgatgctagtttttttttaattcatgaagcctaaacaatcatctgcaaaattatatatctgatcaacaattttttctggatgaatattttctcttagatgatttaagcaacatttggtttatttttaacagtgtttgttttattttatttttgctgcaacaggactcctattgttctggatggggttacaaccacaaacttcaatagcttcgtttcaactattaccttgcacatacctgatgtgactgtcattacacttcaaggtgagcgccggactgacaagaagagttctcaggattcagcgtctctggtaatgcttcagaaacttgaagaactcaaggtctgcatatgcaagcagacacagcaaagcaacatggataataataccagttaa

SEQ ID NO: 796 - DNA, 10612 bp, Sorghum bicolor
acagaaaaaagtaaaacctaaatagtatctaacataggcctgtttgaatccgctactataaattttagagctaaaattcccagaaaaaggtagtccaaaattagttctaaacttagcacacctcatattagagctttatatcttaaaagtaagctaaagtactctaaaatttttagtgctctaggatttagaaaatgcgatccaaacatgccctcattatatgtttttactaagtacgagatcacgaataggatatagaaggtgcaatgccatttgtaagtaaaaaaccgaaaaaagctatcaaacctaggtgaaaaatgacaacacaatgctatagataattagcatctaattataaattaattagatttaaaatatttattttgtaaattactttctacctgtgttttaatttttataaataatttatatttaatattcaatgtatttctgaatatttgatgtgacaactttacataagccacccaaacgcggacatgtgagctcagagttttctttttcctttgtttttaccccttcggtttccttttgtctctgcggttctccctctacctctccggctctccctcttcagtcagcaataaaaggcaaccttcgtcagccaaggacacctcgctcgcccctgcctgccgtactctccggccgttcccgccagagccgcctcgcgcctcccgtactcctccggccgtccccgacggagctgcctcgactgtcccccgccgcgctagcaaccacattttttggacttccccgcttgactttgggcctcccctgcccccaaccccggcaaacagccgtcctccgccacccgcggccggcgacgccccgccttgccgttccgccttgccggaggcggagattccgcgacggaagccgacgcgcggcagtcgattccgcgatggaggcagccgccgccgccgatggtaaccaccagctcttttagtggggttttttctgggttttgtgggttttctgtttattgcagtccctggtgtccggccctcgattgggccatgcagattagggtgtgatcaggctgggccatgtaatgcatgctcgattccactgcttcgatcgcgctaatgcgggtaaactggaggtttgggcaacggttccggatgaagtggtacttggatcggggctttaggggggttcgtgccttcggttgagggttttgggagggtttggcagctaaagcggctgggtattagctatgccgttcgtcatgagacatttttttattccctccttacctgtgtactttgtgggttatgaacccttatgcattttctactagtgatggatttctgttgatctcacttgataaatcatttacattagcaggaggcatgacctcctttaccctgtgtactttgtgggttaataacccctatcactctatgcatttgattttgggtctactggtaatgggtttctgttgaactcacttgataaatcattgttgcataagcaggaggcatgaatcttttgaagaggccatccaactcatcgcctccagaagacgaaacagacaagcataaacggcagaagagggaatgccaggatttcacccccagaaggttctgcacatttgaccaaagaatttcactgttatacactcaggggtacagtgtatcatatgatggctgtgctttgtgatgttgaattgatcaggtaccagcttgatgtctatgaggttgctatgaggcagaacacaattgcgatgcttgacacgggagctgggaagacaatgattgctgtcatgctcatcaagcattttgggaagatcagcaaagcaaataatgatcgaaagctcatcatattccttgcaccaacagttcaactcgtcacacaggtggtttctaccaaagcctgatgattctaactgaaacgaaacaagtttgtgctgatattttctgtaacagcaatgcgaggttattaagagctacactgattttgaggtggagcattatcatggtgcaaagggtgttgatcaatggaaggctcatagctggcaacaacaattcttaaaatatcaggtcagtttcatttctatcttttttcaatcatattgattcctcattttttattctaaaggaaatgatcctcccaaatttgtggcagtgctgttctgcactcttctgttaattagattagatttgctgacagcaggtgttttagctcttcatttactctactttggttttaaagatcatgacatgtactgtatgacatgatatagttattctagcttatgtgcatattgagtttttttttgatctttttgctgcaaatttgatctataaagcctttttttggtctgtgtatccactcttatttttgcgcttagtaatttttgaagatatatgattgtgtggagcttccttcacagtacctttaataattttggtaacaaaaaattatgttcctagattaaacattaaagaaaattactgcagcaaagttgcagaatcctagtttgtgatgctccatttacttacttgacagcccctacaaaattgcaggttatggtcatgacaccacaggtgttgctagatgctttacgccaagctttcttgatcctggacatggttagtctcatgatatttgatgaatgccatcacgcaactggtaaccacccatatactaggataatgaaggtattctgaaaaaaaaaactttcttgtaatacttacaaagttacgaattactttccttttgtcttgctcgtttttaattagtagcttctgttattttgcccttttgaacaggagttctatcacggatcagagcataaaccaaatgtgttcggtatgacagcctctcctatcataagaaaaggcaagtattaatgataaaagtatatattgttcttttttgttgttatctttcagacatcacaaaattccctgatcaggcctgttgcagtggtgagagttgtctcactgagtcaccaggtcgtgggttcgaagcagcctctccgcagattttgcggggggaaggcttaccttggtctgccccctttaaactaacatctccaatggcaagctaatgatctttgtcagaaatgtaattcagagatgaaattgaatcttgatggcttgtaataacattattgagaaatatgatgattatgttggtggtggtttggctgtacgaaaatatcacaaatggtgacattttggccaagtgaaataaatagggctggttgtctatccatcaattaaatacaatgtcacacagttctcctatgtgttcaagaaaaaaaagtgaaaaatatagaattccatagaggaattccgagggtataatctttatttgtattccaccatatgttgctaattcttgcaattttgtttgtttcctaccatggattttgtaccttcaccatttaaatatttgcttttgttttgccattttaccttttcattttgcaggggtctcatctgatttggattgcgaaaatcagctatctgagctggaaaatattttagattccaaggtatgtccctttttatactactttgtttatttattatctatactgcgtgtgtgtataagcttcttagattatccaggacgcagtagctgtgtgattattccaatattccaatttatctatggaacctcacaggcatggccatattgaaatgtgcggtttacaactatacttgtttcatgctacaagatgaaaattgtttacttgcattcctatttagatctgtctttttaggtgaaatatgtccactatgcccttacatttcaggaaaatgccattaactgctcctgtttacattgtaacgcagatacacgctgtggtggatagagaagagatagaactttgtgttccttccgcaaaagaagtgaacagatactatgagccgagaactgtttcttttgaagatttaagtgaagaactggaaattttgtgttccaaggtttcatactctttaataattcctggctctgtcgttgaagtctttaccaaagcttttaagatcgatgtctaaaatcagcatctttttacgtgtgcagtatgatgggctgatcgtacaattgcataacagatcgaccaatcagtacaaagatgctgatgaaataacaaaagaatcacggagacgtctctcaaaatctttagcaaagatttgctattgccttgaagatgccggtcttctttgtgctagtgaggtattagttagattggttttaagctattaatgtttgcccttgttctttttgtcttgagtgttaattctttttggtcttttcctttaatttcacaattccatggtatttatttagataatttatttttctcttaggccactaaaatctgcattgaaagagggcagagaaaaggttggctgaaggggggcagtgacaccactgatcagcaaagtgatccaaatggaccaatcctatttgcagaaatttcaatgcttcatatgaagttctttcaggaagtgttggatataattgacaaacgcctccaacagcaacaaggtatgactgcagattaaactaattcaatggagtactaattgctaatatgtagcattgcaacgtcctatatattaagtatgatgcgtcagtgatgattccctgacatttcaggaattgatgcccttctgaactcagagagtggatgtgtggaagcagcaaagatgggctatatttcaccaaagctctatgagctcatgcgagtatttctttctttcaggtgaagtgatattttcgtaacttgacctgttcattttcaactatgtgtctttacactgacatgagatacatctgtgtctaacagtgactctgataacgtccgatgccttatttttgtggaccgaaagattagtgctagagtcattgagcggacaatgaagaaaataggccgactctcctgtttcagagtctcttttctaactggagggagttcttcagtggatgcactcacccctaaaatgcaaaaggatacgctggattcattccgctctggaaaggtacttaacatctcttaacatttgtgtaaattgaaacatagtgctcaacttctcatgatctgagatctgacgttgttttctttcccctgaaaataaaatgtaggtcaacttactgtttactacagatgttgcagaagagggtatacatattccagactgctcgtgtgtaataagatttgatttgccaaggactacccgcagctatgtgcaatcacgtggacgagcacgacagcgggactctcagtacatactaatgattgaaaagtaaaccctttactttgtagtgttgtctaaactctaaactacttatgcttgtgatggtactatgattgtcatgataataaaatggttacagaagtcatattgtcaatgttctttgcagggggaatgtgaaacaaagtgatttaatatctaggattatgagaagtaagacctcgatgactgagattgcttcaaaccgagagcctgaggattcacaccgcaatttcttccccattgaagaaataaatgaataccatataagcacaacaggagccaaaataactactgattctagcatcagtgttctcaaccagtactgtgacaagctcccgaaggacaagtatgttgactaaatttctcttttgtccttttacatggcctacacagattatatacatttagaaattctgccataccaagtttctgtttggtattttttatttcctgtgtagggttccaacctatttttctgactttcttgctcgtgttgaaggtactacaccccaagacccacgtttcagttcacccattatggtgatggttatgagtgtactgtaacactaccatccagtgccatgtttcaacttttggtaggtccaaaagcaagaaatatgcagaaagcaaagcagcttgtttgccttgatgcatgtaagaggctgcatcagctcggagcacttgatgaccatctttctccatcagttgaagagacgcctctggaaatttcaagcaagtctagtatctcaacatctggtgcaggtttaggtatatgattgttaattcctaaagagatatcatgtatcacatactccttatgttccaaattataggttattttaacattttctgagtcaaacttctccaactttgaccatgtttatagaaaaatacatcatctacaattctacatcatgaaattagttccattaaattcaccatgaaatatgtattgatagtgcattcatttggtttcaaaaaaatagatgttaatatatttttctaaaaatttggttaaagttagagaactttgaattaggacaaagctaaaatgacataattgagaatatgtggagttcttgtttgtagtcgatatacacaatgaatcttatttgtaatatttctttattgtttatttactaaatgataaaaacaataagtatctctttattgtttatttactaaatgataaaaaataataattatctctaatgacagtgttttatttcattctcaaaggtacaaccaaacggaaagagctacatggtacaaccaaagttctttctatgtctggctcttggggttcagataaaagtgtgactaaacttcaaggctacaagttaaattttgtttgtgatcaagttgatcaaaaatactgtgactttgtccttctaattgatacaagtatagcaaaagaagctgctactttaaatattgatttatatttgcatgacaagatggtaaaagcttcggtttctccttgtggacctcttgagttggatgctcgacaggtttgatcaactacattgtctatctactttgttttaaataatttttttttcttacctaaaatatttcttttggttctctcttagatggaaaaaacaaaattgtttcaagcacttctatttaacggtttgtttggaaaactgtttattggatcaaaagcatcaaaaaccccaagggagttcattctcaagaaagatgatgcatttctttggaataaagaaaatatgtatttgctattacctgtggattctactcaggattctcataaaagtgtttgcatcaactggagtatagttgatatagcggctacaactgttggactcatgagaagcatttattcagatggcaaacataacctaaaggataaacttaatcatgaaaaaaatgacgaaaattttattcgtttggccaacaagtcatgcaaagctgatgatcttaaaaatatggtggttttagcaattcatactggaaagatatatactgttcttaaggtatctgatttatgtgctaatagtaaatttgatggtacatctgacaagaaagaagcaaaattccagacatttgcagaatattttgagaagaagtatgctccattttttacatatttatatgcttatttaagaatacatatttaataaacactaaactaacacactttatttacaggtataatatatttctttgtcatcctttacaaccattgctagtgttgaaacccacccataatcctcacaatcttctttcctcaaagaatagagatgaaggtataatttataaacttgaactctgttttcctttttaactgtagccaagttgataattttgtataatgatacaaattgtttatgctttattgttttttgtaggcaatgttgtggaaaataaaaatagggcaaatagccttgttcacatgcctccagagttgctgattccccttgatttacctgttgatgttttgagagtattctatttgtttccatctctgatgcatcgtcttgaatcactaatgctagccagccaactaagaagtgaaattgcatacacagattctgatatatcgagcttcgtggtaaatttatatttcttgacataatattatgttattccttaaaatgtaatgtgacaatccatttccctacacttcctcagattttggaagctattacaacacttagatgctgcgaggacttctcaatggagcgtttagagttattgggggactctgttcttaagtatgcagtgagtgcccatcttttcatgacatttcttaataagcatgaggggcagttatcgtccagaaggcaagaaactatatgtaatgccacactttatagacttggtactgaacgcagaatacaggtaaattacatctcatcattggcaatatggacaaaatgctgcattttgcttcaaaaaatgagctataatgctattttaattaactctgttattggtggaatgccatccatagggttatatacgtgatgctgcatttgatcctcgtcgatggcttgctcctggacagctgtccagccgtccctgtccttgtgaatgcccagtaaaatctgaggttataactgaggatattcacagaattgatgacaaatctataattataggcaaggcgtgtgacaagggacacagatggatatgttctaaaaccatctctgattgtgttgaggctataattggggcctattatgtggaagggggattaaaagcagcttttgctgttctcaaatggttgcagattgagacacttgaggaagagcaaattatggaagccctatcaagtgcttcagtgcgaaattatcttccaaaagttgatgtagttgaatttcttgaagcaaaactaggctacacctttcaagtgaaaggtttgctaatagaggctctcacccacccatcacagcaagaatctggagcaacatactgctaccaggtattgttgatatttatcttaaacttagctagtttaaggctttttattctatttctcattttctctaacggaagacgttttactttcagcgcttggaattccttggtgatgcagtcttagatattttaataactcgccatttattccttagtcataaagacacagatgagggggagctgacagatttacggtctgcatcagtaaataatgagaattttgcacaagttgcggtaaagcacaatctccatcagtttctacaacattcttctgggttcctacaagaccaaattactgaatatgtgaatagtctggaaggttcatccatggacagaaccagccttttatccagtgggccatctagggggccaaaagtatgttttctcttcctctctgtataccagtgcatatgagattccagatcccatgaatgacatgtgctttcgtttaggagtagcatattagtgctatttgttgacatcctttacagcctgttgtacttctatggtagaaactagcatattttagcagctgcaacagcagctgtggctgcaaacaccaaatagattgctactcatgcagccacagcctaaaaaccacagccgataagccctaatgcaaaatgtgattggtaggtccaccatatggtaatccccttttttggctgaccccaaagatactgttgaaacacagtttttaaaaccttggttgaaacattgtttttatctagaatatgacatttcactttgtcttctttcacacaggttctaggtgatattgtagaaagtattgcaggtgctattcttattgacagcaaacttgatctggatttagtctggcgggttttcaaacctcttctttccccaattgtcacacctgagaatttggagttacccccattcagagaacttaatgagtggtgtgacaagaatgggtactttattggaattaaatgtgaaaatcgaggagacaaaacaacggctattcttagcttacaactcaaggacttgcttctggtgaggcaaggttgtgggaagaacaaaatagatgcaaaagcacatgcagcttccttattgctcagggatctagaggtacttccttttatgctccattttttttggtaattcatgctacatgcatgctggttgatttggggcattagcagctcaacatgtactcttgttggcaggaaaaaggacttataattccaaagaatgcaagcagagtggaacaatttgaaaagaattctggtactagaaaccattgcaacaacttggttgatgttatggacacacaaaatgtagcaccacctaggcaaaaggaactaccggtgtcaagtaccgctcctggctctgttcttgataaaccatgtgcgtgtttgtctcagttgttttgttttgttttgttttgttttgtttttcaacctatatatttgtcagatcaatgtctatgcatatcttcacattagtttaatcattcatcttatttgtgcagtggttgtgaaggttaagttgagtaaaggaggacctcgtgtatcgttgtatgagtcgtgtaaaaagcttcagtggccaatgcctatgtttgaatttgtgaaagtcgagccaaggtactactgtttcacattgtgtttgctgttggtttgtgtaaacaactacctaatcttttcacttttgaaaatatcagtgtgtgctcctcttccggtgattcttcacaaaaggttgcaccccaaggatatgcatttgcttcaacaataacattgcatataccgaacggcgatatcatcagcctcacaggagacggacgtgcggataagaagagctcacaggattctgctgcgctgctcatgctctatgagctgcagcggcgaggtagattccaagtccaagaagta

SEQ ID NO: 797 - DNA, 5787 bp, Sorghum bicolor
tatttttgttacagtatatctataatttaaagattagtgtctcaaaccctggtccaccagtattgcatggcattgtgatcaaaatatgcgctagaacgttgttgaagcaaacatagcttaatcaccgtctgcgtagcttaggcctcgtttagatgccaaaagttcaacttatgaactatattgtagtgtttttgtttgtatttgataattattattcaatcttacactaactagattcaaaaaatttgtctcgcaaattacaagcaaactgtgtaattagttattttttatctatatttaatacttcaagatttgatatgatgagaaatattgtaaacttttggaattttggatgcatcttaatcaccgaaagaacatttagccgccaatccttttgtcaacgcttattagtcgaatcagtcagtcatttagtagtgttttttctctcacaataaatcagcaatcgtactttctgtcatgacatatcagtcaaatgaacaatgacaacgtttgtttcagcagcatgttttttctcactccccacctgcattgagacttgtgctataatttttgttaggtcttatttagatgcgaaaactttttggattttgctattgtagaactttcgtttgtttatggcaaatattgtccaatcatagactaactagaaccaaaaggtcagtttcgtgatttgcaaacaaactgtgtaattagtttttgtttttgtctatatttaatacttcatgtatgtaccgcaagatttgatatgacgaggaattttgatttttgttttgtttttggggtgaactaaacaaggccttaaacaaaaactttttaagattttctatcacatcgaatcttgcaatacatgtatgaagcattaaatatagatgaaaataaaaactaattgtatagtttacctgtaaattatgagacgaatcttttaagtctagttactctatgatcgaacaatgtttgtcaaataaaaacaaaagtgttacggtgtcaaaatccaaaaactttttgatctaaacaaggccttagttttaatttttttttttgaaaaatagacactgtagtattttcgtttgtatgtgacaaatattgtctaattatagactaaataagctcaaaatattcgtctcacaaattatatacaaactgtgtaattaattattttgttatttatatttaatgttttatacatatgtcgtaagattcgatttgacagagaatgtgaaaagttttgtaaaattttatgagaaagcctataatcgataaaaaagataagagacgtggtaaatgcacttgttccgcggtacacagcagtctgtcaatacccctcacggccattctggaagcctcactagcatcagtgtactgtgtcccgtaggtttctagcggcggaggtgaggagacaagccctgcgccgtcggtcgccgtcgcggccgcctcctcccgtcctccgccttctcaacaggccgaggtaaagcttccagaatggcggtaagcttcctgcctttctcaatgtatttaaatgctcattcagtttctcttttctctttcctacgagaatggcgtagcaagattgtatcttttgtcttcaatggggcttcagatttattctctccatcccaaattataagtcattctaagaatattggagagtcaaagaatctcaagtttgaccaatattatataataaaataataatatttatgatattaactaagtatcattagattcttcatcaattatattttcataatatatctatttgattttataaatctttataattttttctataattttagtcaaacttaagatactttgattatataaaattcttggaatgacttataaccaactggggtactcacattgctattggttttggttcaattgttacttgagatatacctgaagcgtgatgaactcttgtctcacaggacagggtcggtggcagcgacgacggagacaagtccgagtggaatagtgacggtgaggtggcgaggagcctcgatggcgctggctcgccaattgcgccctcgaggaacaagttaaaagatgctcctggcccgtccctgctggtaaggcagctaagtgatgggtacaaggctacaagcacgcgaatgcgtagctaactcaccacattgttattacgttgtgcatatgaccctaatgtggtgtctgcttgtggaattgtgtggaatcatggtaatgtgaaggtcaatggagcagggccatctgcctctttggtggaggactttgtagggatgggtcttattaaggggaatggtatgtagtctcctatttccccttctgtttttctaggctgtgactgtttttcgtacttcttttgacaactgatcttgctttcaggggatggtggtgcagagtcattactagagctccttctggcatacaaggtattctcgccagtttgcctccttttattgatcattcgttttgatcctcttattggatggtgggaaaaatatattttatttggcaaaagtgatattgtgaaatgcaggcgataggcaatgacccttcattggataaatcctctgcttctgtttgtggcccccggaccatttgtgatgacaaagacattcttgcgaattgggatgcgcatgatgctagtacgagcagtgacagggatcatgcatctgatgattctggtgatgaggtactttcaagctcaacagccctcccataggccataggctacagaaactttcactgtacttgaggattcaattaatttacctcatcccttgtaaattagttttgtacttatttcatggtaaccgtgccctgcacttttggtactgcacaaatcgattacttggccaaaattgtagggtcatgcaatgctgccattcccctttattttttttacaaagaaacagtgcctgcattggatatatagctgtaacagaaattggatgtgctttatttcccgtttttgtttttcctttttattttgagggtctgttgttttgggcaaactttcatagttccatatgattattaagcttgctaatccaggtattgattccatgcctctttcatcttgaacttcaatttttacctatggtaattgtatggtgcaacctgcaacagcattcgtagttctatctatcaatgaatttgtcttgtattatccattgtagtactttgctatttttttctattgaatatatgtacaagcaggttacaactaggttggagttgtaattaatgattagggatagagtttgggttgtgctataaatataaggacatcactattgtgatatggatagagtttggtggctggtgtgggcggcagtggcagttttactgccttcatcgggtggctgcggtgggatgagcatccgtagaccgtagtcatcaccctagtgatgtagaccactttggctgaacatagtcaacaaatattgcaccttgacatcattctgttatgtggctcttgagataagagcatggtgtgtgtactttctatgcttccatgctcatcaatttgaggctgttgacgtgttgatattattgattgttttcttttttacagacttgtgtatctagagttgtatgcagctaaccggttgaattaaacaaattgatacctaggtactaaaattttctatttcctagttatgccctcggtacctttgaaggactgttaaatgttcttccgtagaagtccaggttccatctatttgtataatctcagtgctttctaatatggtttcctgtgcttttatgcaggatttcctacagggcttgtcacagaaggatgaaaaaattgagtccttagtgagaatgggctttcctaaagatgaagcagaaatggccattgtcagatgtggtatgctctctattgaagtttctacaaatgtctttttggtcatgagtagctcctttctgttgtttttacaggcaattgtatgatattttacattttaatcaccttatttcacccacctcgttatgcatatttgcttacaagtacccagttatatgtactcagcaaaataagttagttttgtagaaactttgttttcaaggttaagttccagattagtggcctatgttattttatagatcaatcaattggctaacagcactgctatgtttaatgtgactattgagttcttttatttaggttttctagctttctgagaacattcctcaagtgtttaagcattaaaccagtggcgtgaatgtattgtctgcataaagtcaggggttgtaggtaattttttgagtctgaagagagagcactaagggtatcagccactcacttgctatcaaataatttttttcccctgtaagcatgcatatctcttgcagactcgtacggtcttatttctgagttacgtctacctacagaatttgttccgtgactttcttgttagacacactccaaatgccttgttcactgattctttctactttggtttcaaactacaagggcaggatgcacctatgtctgttttgattgatttaatctatagttcagaagcttcagaagatggttactatggcaatttctctggccatgaggtaagtatatatgtctatttcggttagcaaagaaatgtttggttccttaaattggatggactgaaactagaactgtgttttgtaattctacaggatgattcttttggaggaagaaaggaaaagagaaagagatctgaagatgcagaacaaggcagtagccatgatgagccgatgcctctcccaaacccaatggttgggtttaacctgccaaatgtgagcttaagatcagtggacagatctctaccatcaaaggctattgggccacctttcttctactatgagaatgtagccattgctccaaagggtgtctggacgacaatatcacagttcttatatgacatccaacctgagtttgtggattctaggttcttatgtgctgctgccaggaaaagaggttacgtacataacttgccaattgagaacaggtcacctctccttcccttacccccaaagacaatatttgaggccttcccccatactaaaaagtggtggccctcatgggaccctagaaaacagttcaactgcctcctgaccagtatggctaaacctaagttaacggaacagattcaccatgctcttgcaaaatgtaaagatccaccacctcgacgtgttcagaagtatgtcttggaaacctgcaggacggcgaacttggtatgggttggtctgaacaaggttgctcatctagagcctgatgagatggagttcctgcttggtttccccaaagaccacaccaggggaatcggcaggcctgagaggttcaagtctttgggcaattcattccatgtcgacaccgtcgcataccatctctcagcacttcgggacatgtttccacatggcatgaatgtcctttccttgttctctggcattggaggagcagaggtagctctccacaggctcgacattcgcatgaagacagtcgtttcggtggagatatctgagacgaacaggttcgtcttgaggacttggtggaatcagacccaaacaggcactttgatagagatcaccgatgttcagagcctgactaccgagaggctcgagtcatgcatcaggaggattggtggttttgacctggtgattgggggcagcccctgtaacaatcttgctgggcgcaatcgattccaccgtgatggcttggagggagagcagtcgtcgctcttctaccactattacaggatcttggacacggtgaagtccatcatgggcagaatgtag

SEQ ID NO: 798 - DNA, 8672 bp, Sorghum bicolor
aattgtgcaattagtttttattttcgtctatatctaatgctttatgcatgtgctccaagatttgatatgatagaaaattttaaaaagtttttagtttttggagtgaacgcctaagtctagtggcgagcgcgatggagcgacgctcaccgggacgcggcggggcacatgaggccgatagagtagagcaatggcatcacggtggtgtttgagcaaataattgagccacactaatatctcgctggcaccgaaaaacatcgcctgctctaaatagtttggctgcctgtttggggttgcttctctcctcttaatcatgctaaaagctatatagattctagatcaacatattttctcatgattattctctccgtatcctgcttcaacttgaccgttggatggactgttagtcagcagtggagaaaatcctcttgattctctcctttcctttgtctcggctccacctgctcaaagctctactcccgcctctcctgcttgagccttgcctccgcctctgcctcacccagcatcaggacctaagcgtcgcagactcgctgacacactcgcctccgcctcctcactcagccaagattgagtgttttggactagattttaattttgagtgttttggatctaaatgtaaatggttaggaccacaagtttaaggactgccactgcatttaactctatttattatataaaatatattatatctaaaaataattacatgtataacaaagcactacttatttgatataataaataatttaataacatattttatataaaaatcatataaaaacgatcacatgctatcgctatatctacggtgctttaaaagctatatcacactataaaatatatgacaactataatagcctaaataacttaataatattttttatattaaattatataaaaccagtgaaagactgtcacgcaatgcgcgtgacagctagcggtgccttaaaggcgctgtggtggatgacatgtcctgtcaccaccacataaatacagtttttctctctcttctcattatcttgagatctgcgctgcgccgcgactctgcatctggccgtgtgcctcaccaaattcgaaatggaaccccgactccatctgcttctgttatcatcgggaaatgctccccacaccggtgaccactgatcagccgccacacaggatctttcaccacctactttctctgtctacaaataaatattgcatgtgtaaatcttgaaaaattaaacttttttaaatttaactaaaaatatattaaataattttaatatttatatatataaataatatattataaaagtatattttataccgaatttaatgatatatattatatatgataaatattagtatatttttttatatatttgattaaacttaaccatgtttgactcaaaaaacgagacgtacatttattggtaccggcgttcccgggacagtgccgcactctctcgctgacagccctggcacacatgaggctgtccccacatgccagtggcgtaccaccagcgacctgcccattgctggtgctgtttggcgggcgcggcgcgtgagtttcttgttgagacttgcttggagattcgccgtctccccctctcgtctaaaagcgggcaaagcagagacggtggaggcaggcagagccgccctgtcgccggcgcggcctcctgctcctcctcctcctctgccaccgcctcccaactcccagcgcgcaggggccgacggcgacgggaggggagaagcggcagaggtagtccgaggaggggcggggccgacggcgacgggaggggagaagcggcagaggtagtccgagggggggcggagagaggctgcgccgtcccactccgtccggtgcctcagcccccggagccccttcgcgaaggttcgggaatggcggtaagacctcccttcccctgctttcctctactctgtccccttccagcttcgtttggctgctggggaaagtaatacaagagagaaatcccccacgcagggattgggttgatcccctcccaccacccaatcccctcccaccaacgtgatccaatcccttgattccctggcatcatttggattgtgcgctaattagctcagtttggcgttttattgtgttcgtgtactactaatgctcatcaaagctaattcaatgttgaatttactgattatttaaccataattcaaaatggtagtgttctagaattcagaaccgaaccatgggagagcacaaaaacgagctctaaaattcaagaaaatactagcaaaatccatgtctaaaattcaaaaataacagaaaatgagcaagagaagccatttttcatcagtaaaaaataaaaaataaatgtattggaaggtgcagcaacgattgaaacattataagaaaaaatatgtcgaatgtaatcacatcacatggtcatataccagaacattcttcaccaagtttcgaagtagctcacggctaagtaaggaagacgtgaccatcagcatattgaactagggcttgcacatgcatacacaaatttaggaaacaagacatttgttttcaagattcctaaataaataaaatagtgctagcatcccagcggtgccgaaagaagttgaactgaaaccacttagacttgcacttgaaacgaaaggtgcactttcacttctttcctgcaagcaaagtattcatacttttagacattggtgagcaacaaggcaagaatacttttacaactctgaatcatctgccagactgacgaaacggaagaccgaaagcaagctctattgtacaaagtctgaaaactactctgtaagaacaaacaatatatgatcattcaattctccaaagtttttcacagtcagtcagtacacttgtattgctaaaagatttgctgacgagaggcagcgcttaagtcaagtacacttgtatcattgactattatatactgtgcaagaccccagggagatgagcaacaagtagagaactcaaagaacaaaatttctgaaccactctgttggaccacggctagttcaacactgcaaacacctcaaagcagcaaacaaatcagcaataatcgtgtacagtaaacacaaaatagcttccaggtcagtgccacatttccaagaccataagaaaaatctatagtatccgattacattaaagagaatggagagagcatattttagtgatacaacatagttaaaattttaatgatataaaaggacaagtttaggcctaatctgcttcgtactgtttcttcaattgccttgtttcccttatgtctgcatagtgcatactggttcaaagcaaagctttctagtgagttcatgaaagtaatgaaaaaaatgtcagcaaactcaaagacaaaactaaacaactaaccatttcttccttatccaaatcagacgtgttgttgaatctgcattcatgaaaatttccttgttctaagcatctttgaaaacatcaaaagcttcaaccttttcttcgctagtgagttctaccatggtgttgatgacactaatgcattccttgatgaagtattcatccgctcctgatcctgcccttgatttctctgcaacctcaccaaagccatacctaaaaatcacagaggctttctgctgtttcttggacaaggtcacagtcgtggggaacaaaaggagaagggagaagctaccaataatctgtcaaaacgaatgcacaaaaacaagtcatcacagatctgaaattttaagatggataaaagataaccctgagctacttaagcccatagctaattagatagacatatatgctacaagatgtgaaagtaattagacagacatagctactcaagcacatcatcagtaagaagttgtaagctcaaatcaacatattgcagcaagaacccatcctctataatattgtataaatgctagatggaaatatttgcagacaattacattgcaatttttcttcaacaatagctctgattgcctagtcgattccaagtgctttgaagaaaaaagattgaccaagatttgttgtctacaaaacaaaaaaaaaacagcaggttctagattagataatttattacatactagtagtaggcgagataaacaacatcataagaagataatgagaacattcatggtgtagtattgcagccacttgtcaacaagattacagtcggaaaattataggcatgcaacacatagaggtagtacatcagtgtatatataattttttataagaacagttatagactgctttacaatccaacccaatcttatttcagaacaatccatttgttaatagaacttcataatccaacccaatctcagatcagaactctaaaaatgcacaacaaagaaacttagcaagacaacatagagtggacagggagaccaagccagacctgaatgcagtttctgtgcatccacgtggatggaactccagcgtgggtttgcttccatgggaggccggaatcccttccgatccccgcagatccaaggctatccaaacgaagcctccatgtattgtgaagggatgatctctcgcgccatgaattcttgatgctaataatctggtccactgctacggtgattccgcgcgttagattgggttccctgatgtcgcgaggttgggttttgttcccttttgctgctcagcgctagggttttcttaacactggatcaagttagagcttgcattttggatgctatttcgggattgatggtggtttggtcctattgtttctcgatgtgcctgatgtttagttcttaattcgtgtcacagcactgggttagcgacggtgatggcagtgacagcttcgaatgggatagtgatggcaatggggaggaggcagggagcttcaacactgctggtgccagttcatcagcaatggcatcaacgaacactgacgctccaggcccatcgagacgggtaagccaggtaactgatccatacatgcagcaatgtgtgaactcagctagttgttcttcagttcatgttactcagggtttttcaaatcacttgcgctaaactggcctgggtgggggtggatatatatgataatcatgaacaaaatcaggatcatgattagtgtatagcgacacgaacactctttgtgttactgttaccttgtttctgctggctaccattgtaatgtttctgtttgtttgtggggccgattttaaggttgctaatggcaatgggaaggctgggccatctgcctctttggttcagaggtatatagacatgggtttcgcagaagagattgttgtgaaggccataaaggacaatggtacttagctaataacccatttcttctcattcacttagattctatgtgattttatatactctacctgacagctgctttttttctttcaggcgataatggagcagatgcattagttgagctgcttcttacttaccaggtattcatttgtgttcgtgcttctattagttattctttgatgatgttttttgcatggtgtcaaaaaggatttgtatttacaaagtgatgctaaatgcaggaactaggcaatgacctcaacgtggataacggctttgcttctggttgtgtcccccaaactgttgacgatagtggtgatgatgactttctagaaaactgggatgatttagatgctggtgggagaagcaccagagttgctaattctgttgatgattctggagacgaggtattttgacgcgcccccttggtgactgtacgcgtttactttattcttttgagaaacctgctatgtatttagtttgcttcaatcatatatatacttatgcattaaacttgtttaatgttaatccagtaagtagactgcttataaaaaaaccataaggttccttacttttacttgcacctgttcctttggttttcaaacagctgttagctacatagctgtactagaaagccaatctactttgttttgtcccttatcttttgggacaaccgggttcttttaggcaaaacagcatgtttgaatgaaaccaaaatcattaattttgtaagaaaatcgtatcactaagacagtaagcaagaaagttatgtcaatcataaacttggaactattgcatttcatcttatgcgtatgattagaactttcgtgttaatgacattcttgaacaagacgccaccatggactaacaaatgaaattgcaaaattgtgggtgggtcattaatgatgttcttattttgtatctgacattcatttctttgtacttaagtttggtgtaccccctcctccctgtaatagcactctctcctagtgttttaacttttaattcacgaaaaaacccttcagttatgggttataaattataatctatttcctttttttgatacttgtgcaattgatcactgatcctgagaattggaggctctgtgtgcaacaacattcctgttcaactctaacattgaacttgcattgtactttctggtgtttggcttgcgacttcatgtagctgagagttgattgaattggactacagctggacttccatttttttacagttacatttgtttttgtcaataagaaactaattgttttcctaacttgtccatagttatgatacttcccatttttatacatattataagaattgttgtttttgtcctttggaaggtaattggaatgctagtttatgtagcttgtcaactgtattctcagtgctttcctgtgctttctacacaggatttcttacatgagatgtcacagaaggacaacaaaattgattccttagttaaaatggggtttcctgaagacgaggctgcactggctattactagatgcggtgtgctctctgaacctttattccatgctcctctgtttgccttagattcagtttccaaccttgaaagtaggatatgctctcatatagaataaatcagttgagtaataacattgccatgtttaattatatgtctaactttctattggtttatctctggaatctggattttgagaattttcctcaaatgctgtaagttggaactcgtaaattggctacaatcttgaactgagataacctagaatggtttattctttccaagcttgatttactcagattctgtccttgcccctgttttattttaacttatcttcagagtttatcattagatcttgtctaagtattctccaaatgcccctgttcactgatcatgcaccttacaccatctactgtcgtctgtggtttaaaattactcagggcaggatgcgtctatttctgttctggcggattctatctatgcttcacagaccgcaggagatggttattgtggcaatttgtctgactatgaggttcgtctttggtgaactgtccatacaagtctgcaataagatttagttctaatttaatggtctgataatggaactgtgtttgcaatactgcaggatggagggagaaacaaaggaaggttcatggatgggaacaacaaaaagagaaagagatatggaagtcaagcactgggaagtagaggcccattagatggtagcgctgatgaacccatgctgctcccaaatccaatggttggatttagcttgccagatcagtggccaagaccagtgaacagagatctacctgcactagctatgggtccaccatacttctactatgagaatgttgctcttgctccaaaaggtgtctggactatcatatcaagattcttgtatgatattcagccggagtttgtggactcgaagtacttctgtgctgctgccaggaaaagaggttatatacacaatttgccacttgagaacaggtcacctctcctccctaaacctccaaggacaataactgtagcatttcctcataccaaaaggtggtggccatcatgggacccaagacaacagttcaattgcctccagacttgtgtgtctagtgcaaaactgttagagaagattcgcgtaacccttacaaacagttcagatccacctcctccaagagttcagaagctggtgttggaggagtgtaggaaatggaatcttgcttgggttggcttaaacaaggttgctcctctagagcctgatgagatggagtttctactcggctttccgaaggatcacaccagaggtatctgcaggacagagaggtttcgatctctaggaaattcatttcaagttgatactgttgcttaccatctctcagtcctcaaggatatgtacccagaaggcatgaatgtactatctttattctctggtattggaggagcagaggtggctctccacaggcttggtatacgcatgaagacagttatttcagtagagaagtctgaggtcaataggacaattctgaggagttggtgggatcagacgcagaccggtactttgattgagatcaatgatgtgcagacactgacatctgagaggattgaggcatatattagaagatttggcggctttgatcttgtgattggtggaagtccctgtaacaatcttgctgggagcaaccgtcaccacagaaatggtttggagggcgaacattcttcattgttctttcagtatgttaggatcttagagtccgtcaagtccatccagcgtttatagtctttaggatcttcattgttttggttctggaattgtagcatctttcgttgtgatcaaacttgtgaataatttgaacgtcgactggtgtaattctcatgtcactctaatttaggctacttttaattttatcccctttggtg

SEQ ID NO: 799 - DNA, 5984 bp, Sorghum bicolor
tgccctgacgtgcctgatgcactttgtcattagacttccagtgtaaaagaaattgatttagctaaactttaattggtgaactatatatgttgtgtttagacgcttaagtgtttttcggataatatacatggtcataaacaatcatgtgtgacttaaactatcaaaaaatgttgttacctggttgttttcaagagcgtccttaaaataaagccatggcgttagcatgggcactatactaaggatatgaacttggcgttcatgatttggactagattttaattttgagtgttctgaaccgaaatggcagagcgccaacacatttaactctatctattctataaaaataaattatataaaagataaccaaagttagttacatatatgtatattgaaacatcacttatttgctataataaataacttaatagcatatcttatataaagattaggtagaaatagtcaaaagctattacactggatgcgtgacaattatagtaataattgaacgactactacatatgtgacaactgtagatgggtggtaggtaaattagctcgctctaccagccacgcaaacacagttctctccacgccatacaaatatagttttctctcaactttcgttgagatgtgcgcgactctaccgcgacatcaaattcgaaataaaaacttagatcccaatggtttctgctggtggtgttggaatatagggatatagaatgtgggataaggaaagacaaataaataaacaactaagattaaataaaatataaagaatgaaagattaaaatataatattattttttgaaaaaaatcaaatatcactattctaatctcgatccaatatttaggctttatttagttggaattttttttgcagtatttttatttgtatttgacaaatattatctatttatggattaactaggcttacaaaatttatctcacaaattacagacaaattgtgtaattaattattttttaaatttatatttaatactctatacacgcaagatttaatgtagaaaatatgaaaaattctgtacaattttataagaactaaacaaggcctactatcatccggaaatgctctcgacacgtgacgattgatcagccgtcacacgggttctttcaccgcctacgtaccggcgtaccggggacggtgccgccctctctcgctgacatccctggacatctgagcggtccccacaacacagtggtgtacaacgagcgatgtgcccattgcccgtgctctttggcggacgcgtcgcgtgacggcgtgagtttctcggagtcctggagattcgtcgccgtcgcggcctcctgctcctcctcgtctgccactggcttccaagtcccagcgcgcaggggccgacggcgacgggtggggactggggagaggcggcagaggtaatccgggcaagctgtggagcggagagggcggagagaggctgcgccgggccacgccgtccgggggtccgtcgccgcagcttccggccacgccggggccgtggaaaacgagagggatcgagggaggggtatccgtcggagcccctttgccaaggttccggaatggcggtaagacttccctttctctgtccccttccatgtattgtgaaggaatgatctctcgcgcgatgaattcttgataccggggttttcttaacactggttctcagttagaacctgcatttttttatgctatttcgggatggatggtggtttgatccattgttggtcgaggtgcctgatgtttagttctaaattcgtgtcacagcactgtgttggcgacagtgatggtagtgacaacttcgaatgggatagtgacggcgatggggaggaggcagcgagcttcaacgctgctggtgccagttcatcagcaatggcatcaacgaacgctgatgctccaggcccatctacacgggtaagccaggcagccagctaactgatgaatgcatatcagcatatgcaacaatgtgtgaactcagcagctaggtgttcttcagttcatgttacttagaggtgttcaaaccacatatggtagtcatgaacagaaacatgatcgtgattagcatatagcgacacgaacactctcaatgtatactgttaccttgtttctagtggctacgattgtaatatttctgtttgtttgcggggctgatttgaaggttgctaatggcaatgggaaggctgggccatctgcctctttggttcataagtatatggacatgggtttcccagaagagattgttctgaaggccatgaaggacaatggtacttagctaataacccattacttagactctaggtgattctatatactctatctgacagctgttttttctttcaggggataatggagcagattcattagttgagcttcttcttacttaccaggtattcatttctgttcctacttctaatagttattctttgatgatgatgttgttgcatgtcaaagaggatttgtttcacgaagtgatgccaaatgcaggaactaggcaatgacctcaaagtggataatggctttgcttctggttgtgtcccccaaaatgttgacgatagtgatgatgatgacattctagaaaactgggatgatgaggatgctggtggtagaagcaccggggttgctaactcggttgatgattctggagatgaggtattttgatgcgccaccttggtgactgtatgcgtttactttattcttttgagaaacctgcttaaatcgtatatacttctgcattaaacttgtttaatgttaatccagtaagtagactacttatgtcgaagaccataaggttccttacttttacttgcacccgttcctttggttttccaccagctgttagtagggatgaaaatggattggatatggtcgaatatcaccgatattacatttgttttcatattatttggattcgaatacggatagtgtcagctatatcggatgggatacgtagatgttgacataataaatatacgacttgagtattcagatacggatacggtatgaaatgttgaatatctggatttggatacggacagatctaaacacctctaaacggatttggcctctaatacggtcggaaaatacccttaccgttttcagccatagctgttagctacatagctgtactagaaagccaatctactttgcttttcccttatattttgggataactgggttcttctaggcaaaataacaggttcctgtgaaaccaaaatccttaattttgtaagaaaatcatattggtaagacggtaagcagtgtcaatcataaacttggaactattgtgttccatcttatgtgtatgactagaactctcgtgttggtgacattcttgaacaagacaccaccatggactaacaattgaaattccaaaattgtgggtggttcgttaatgatggatttcatattttgtatctgacattcatttcctttaacttaagtttgctgtaccccttcctccctgtaatagcattctctcctactgttttaattcacaaaaaaaatagttatgggttataatctgtttcccttttgatacttatgcaaatcaatcactcctaagaattggaggctctgtagtgcaacaacattcctgttcaactctaccactgaacttgcattgcactttctggtgtttggcatgcgacttcatgtagctgagagttgattgaattgttttcctaaaattgtccatacttatgatacttcccatttttatacaccttacaagaattgttgtttttgtcctttgcttgcaatgctagtttgtgtaccttctcaactgtattctcaatgctttcctgtgctttctacacaggatttcttacatgagatgtcacagacggacgagaaagtttattccttagttaaaatggggtttcctgaagacgaggctgcactggctgttactagatgcggtgtgctctctgagcctttgttccgtgctcctctgtttgccttagattcctcagcaaaataaacaccaatttccaaccttgaaagtaggatatgctctcatatagaataaattatatgtcaaactttctgttggtttatctctggattttgattgataattttcctcaaatgcagtaagttggaattcgtaaattggctgcaatcttgaactgagataacctagaatgggttatccatccgattaatagatgtaaagctttgattctatgagtagcaaacatccagatgctcattcatagcaggcaactaacagtttattattcttttggggtcagaatattttaattgcgtttgcagtcaaataaaactgttttcgcaagttgcatgcaacttgtaccactcagattctgtccttgtccctgttttattttaacttatctttagagtttattatctgaacttgtcaaagtatgctccaaatgcccctgttcactgatcatgcaccttatgccatctactgtcgtctgtggtttaaaattactcagggcaggatgcatctatttcggttctggtggattcaatatatgcttcacagactgcaggagatgtttactgtggcaatttgtctgactatgaggttcgtcttaggtgaactgtccatacaagtctgcaattagattgtttctaatttaatggtctgataatggaactgtgtttgcaatactgcaggataattcctacggagggagaaacaaaggaaggttcatggatgcgaacaaaaaaaggagaaagagatatgaaggtcaagcacacggaagtagaggcccattggatggtagctctgatgaacccatgcctctcccacatccaatggttggatttagtttgccacaccagtgcacaaggccagtggacagatcactgccttcacaagctatgggtccaccatacttctactatgagaacgttgctcttgctccaaaaggtgtttggactaccatatcaagattcttgtatgatattcagccagagtttgtggactcgaagtacttctgtgctgctgccaggaaaagaggttatatacacaatctgccacttgagaacaggtcacctctcctccccatacctccaaagaaaatatcagaagcatttcctcataccaagaggtggtggccatcatgggacccaagacgacagttcaattgcctccagacttgtgtgtctagtgcaaaactgttagagaggattcgtgtagctcttacaaacagttcagatccacctcctccaagagttcagaagtttgtgttggaggagtgtaggaaatggaatctcgcttgggttggcttaaacaaggttgctcctctagagcctgatgagatggagtttctactcggttttccgaaggatcacaccagaggtatcagcaggagagagaggtaccgatctctaggaaattcatttcaagttgatactgttgcttaccatctctcggtcctcaaggatatgtacccacaaggcatgaatgtactgtctttattctctggtattggaggagcagaggtggctctccacaggcttggtatacgcatgaaaacagttatttcagtagagaagtctgaggtcaataggacgattctgaagagttggtgggatcagacgcagactggtcttttaattgagatttgtgatgtgcagacattgacatctgagaggatcgaggcatatgttagaagaattggtggctttgatcttgtgattggtggaagtccctgtaacaatcttactgggagcaaccgttaccacagagatggtttggagggcgagcattcttcgttattctaccactatgttaggatcttagactctgtcaagtccatcatggagcgtttgtagtttttagaatctttattattttggttctagaattgtagcatcttttcttgtgatcaaactggtgaatgatccgaaggttgactggtgtagttctcatgccactctaatttaggctacttttaatttaatctcgtttggtgatcaatgcaaattgatgttggtgc

SEQ ID NO: 800 - DNA, 5487 bp, Sorghum bicolor
caaaattttttaggaactaaacgaggcctaaggaaacaaggtggaaacgaaaatatggcaaaagggaaaggcgaagtgagtcaactatttcattcatcatttagtctctttcaataaactctgaggatcctatatatacatgatcgtaggccttacacatggtcaaaatgccttaacacatgctctagattcggagcatattccagtaaatccggggtagttggttcggcgctccttggggccctagtcaccaccgcccttaaactatctcaaataatcatcacccaaaagacacatgtctttgggtagcgctacaggtaaaagttttcatacctatttttagtcttatccaacaacaagacctaaaagataacactctctgcaaatgggtctcgaggagagaggatacccaaatttgggttatgcctctcctaatacccaaagtgggtcttctgtgttggaggctatagatattgtgttggagacccattttggatttgggttcccaaatgggtcttctgttggagatagccttagctagcacctggtcaagagaccacctagggcattgtttgaatgttgtcggattcacttcaatccatgtgtgttgatgtggattggggtggaatttagttcaagttctactctaatccacctcaacacatgtggattgatgtgaatccgactacatccaacgtagattatgcctccttcgtccaccgtcgatgcctacaaaccttgacctggctctctcattttgcctcgagcgttcttgtctcttttcgagactccaatcgttgttgtgacaaaatctgatgatcacctatagatgatgagaaatgctcataaagatggtgaaaagggtgcaaagtgtgatgtcgaggctcgtggccataatgttgattgaaaggccatagtgctgtcaaaaaaaattatagaagatagaaggccataatgttgtaaaaaaaaaaatctttttgctatatctctgctataaatcctctagaaatcttactataagaaaacctttttcaactaatgacatagtgtcaaataataaatatgacttctatatttaaaggaagtacagaaacaggaaggtcagatatgtgccattttatgcttctcttcgtatgtcatagatgatacttataccccattttatgcttctatggaaaaaggtttctattagactgtatcttcctgtttctattagaaggtcagacatacttataccccgtttcatgcttctatggaaagagtatccaaacttttttccaaatcataaatatagtgtcaaataataataatataaatatcgcactccctgtttaataaaccaaggcttaaaagaaaatcaacacaggcaaacgacaaaaaaaacaaccttggaaatggcagaaagaaaaagttacagagcgagccctcgaaccccggtcctagggacggctccaaagcggtggaagtagcagtggcattttcttctgtcccgtgcgctctccccagtcccccacgcccaaaaccccaagtgcctttctcgccgcttccgactccgccatgccaccatagatccagctagggcggcgtcgttgcgttcaatcctgtgcgagagaacgcgaatcgccgccggcttgatattggccagggctttctccgcccaattgcatcaggtctcgccgtcatttgcagcgaccgtgctctaattggggcgaaaaggtgagtcctcctccggtcctcccattacactttttcgatgcctggatcgacgaacatttgggagaaaaaaaaatcccctctttccctcgaaagattcgacaaagaacggttgttctttgtgtacaggaatcttatctgctgaatccccgagctccggcgatggattttgacatggacgactacatagacccctacgaggaggctgaggctgaggctgccgcgggcgaggacgacgactccgacgaccccgacgaggacgactcggatgcggagagcgactacgaggagaagtcgttcggcctcctcaagtccggcaagcaccgggtgcgcaacccggacggcaccttccgctgccccttctgccccggcaagaagaagcaggggtacaagatcaaggacctcctccagcacgccgacggtatcggcgtctccagcaagcaccgccgccacggccgcgagcgcgccaaccaccgcgccttcgcgcgctttgtccgcaccgatccggacttcgcggaagacctcgtcggtatcactggcattcaaggtgccattacaaccacccctgctgataagaatggtggcagtgccaatggcgacgggaaggccaaggctaatggagatactgctggatccagttccgtggcggcgaaagtgggtccgccacaggaggttgagaggtttgcttggccgtgggcttgtgtgcttgcagccggggcagggttcaatcctgaggagtttgctgatagagtagcggtgtttagtttggttgaggttgtgcctttgtttgttgatgagatggaagtcacagaaacctttgcaatcgtgaggtttaccaatgattggagtggattcaatgacgcgcttacgcttgagaaccattttggtgtcaataagctagggaagaaggagtttgagacgagagacagtggtctaggttccgtggagggagatggcggcaaaggtgaagtcaaggtttatgggtgggttgcccgagccgaggactatgatgcaacgagtgtggtaggaagattcttgagaaagcacaccgtcctgaaaacaatagatgaggtttccaagactgaattagagaaatcaggggagatggtggcaatactggcatcccagatcgaggaaaagaaccgatacttgcaggatttggagacaaagaagaatgcgacagaactctccatctcaaggcttgaggacgacaacaggaaactgcatgaggcatataatgaaggtaatctgtgcaatttctctcccttccctttggttctacttgatggtttagagtttttcctgcatgcttgatatagtcatgtctagagcatattcacatatgttaactctgccttgtactttacgttttatataatttttatggaagtcctgaaactatttggttggtttttgttccctctttatattgtacatggattatttggataaaagacattatggattggttagacaaatgcaggacttattgagataatattatgatgcatgaagttactccatgccttatatgctttagcattatatttatcagttagtcaagactaaagacttacctgatgagatgaactttggttacatgtaatgacaaactgctcccaatctttaattttgagtgcttgaattttgtggctttacaaaatcaacaaagcaaattttctctgttggaagtcatttatcttataaattttatatcttttttttttcagaaatgcgcaatcttcatcgcagggctcgtgaaaatgctatgcggattttccaagagaatgaaaacttgaggattgacttagaaaataagaggagagaactgaacttacgagctaaggagcttgaaaaaatgtcagctgagaatgctaatgacaggaagacactcgatgatgagaagcagaaggtaagctaaacaactctacaagtgaagcactaagctatgcacatgtaacctcttctgaagtattatgtatatggtgctctaatctggatttattggggtgtcaaacaatcttttatttgcctgtctgagtttaccgtataaacaaggactccataggtctcccttttttttttacaaaggttgttttttgaaaatgatataccatcaatactttaacctagacaagggacacattgctgtcaagtattttatcgtcttaattctatggcatttccccaaggacaccaggtttctttctactacctaattgtgtgcatataaaataaaaataataacagcctgagcatatcattatgatagcataagttcttgctgcagtatcttatacattccttttgtgtttcttctgaaatgtacaggcaaaatatgataatagtgaacttgagttagctagcatagagcagcagagggctgatgcagatgttctgaagctattggctgaccaggaggtttgcgctttgcacatttcttaatgttgttttctacatgtttctctataatctgaagatgagaattgatacaccttaataccatcagagggaaaaggaagaggtacttgctagaatgcttcagctagaaaaggagctgcatgagaagcagcagcttgagcttgaagtagaacggttgaatggtacactccaggtgatgaaacatttagagggagatgatgacgggggagatatccatgagaagatggagaagctgagtgtaagatttgagcatgaaaagaagcgcctggaggatttgagtggagatctcgtgagaaaagagcgtgaaagtaatgatgagctacaagtggcccgaaaagaactgataaaggtactgcctattttctcttccatgcacctaacaattcctctaccaagttgatgttcataaaatgattttaattggtgaaatgattttcacaacgatcagggtttggaggaagagctggatgggcagacagctattgggatcaaaaggatgggggaactcgatgaaaagcctttcctaaatgcatgtaagagaaaatatggaaagggtgaataccagataaaagcagcagagctagtcacaaattggcaggaggaactaaagaagccatcctggcatccttttaagatggttgaggttaacggagaaaataaggtacttgctcagttctgtccagctatgcgttatctttaatgtttatataacctattagtatttgctctgaaatcatattcatcctcatttgctgcaggaaattctggttgacgatgatgcaaaactgaagcacctatggattgagtacggcgacgatgtgtgtaatgcggtgaagactgcactgatggagataaacgagtataacccaagtgggaggtatgtagtgcccgagctctggaacttcaggaaaggtagaaaggcaacgatgaaggaggtgctcaagtacctgttcagtcagatggacacgacgaccaagcgcaggaggggctgaggaggcgccccgaggccgagaagccaataagtagcgcctttacgctgctctgtcagtcgtgtgctgctcgatcttctagttagtggtagtctggcataataagtgttcgtaatcaaggcttaggtatgcatcatgttcatgctgttgccgggcaggcgtcctaaaaacctatgtgatcgttgaactgactactgagtaatctttcgtgctgctattattgttcgggtgtaaatagtttggtgcctgctccttcgtggctttctcgtgtgtgtaatcatttgaccgttcatttgtaaatcattgaatcatcatgctgccttataatcagtaggggctttct

SEQ ID NO: 801 - DNA, 2548 bp, Sorghum bicolor
  misc_feature (277)..(376): n is a, c, g, or t
ttgttctgtctaatcaatgcatcattcttctttaaatgctgtatatgagcttgtgacttaccactcacacttcccttttttctgttgtcccttgggatttaatgcttgcattctgtcattcgatccacgtatactacagggaagataccatgagtgtgccactgacaatgatagaaggaaaatgtgaagttaggatgaaggacgaccttccaaattcaaatcttccagtgatagttgagcatggattttactgggaacttttgtttgaccctgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttgtgatgatgagctagatggttcagataaaaaggatatgtcgtcagacaactctcttgcaacccttgatatttttgctggctgtggtggtttatctgaaggattgcagatagctggtatgtacttgtcctgcagattctatacgggttgatgggaacaccttgattgccacagctgtttcactttctgatcatacaattctgcaggtgcgtcaaaaacaaaatgggcaattgaatatgaagagcctgctggggaagcatttggtgaaaatcacccagaagcagcagtatttgtggagaactgcaatgttattttgaagtatgaccattgtttatcatggatatgcttattcatgcaccgcaccttccactcatttctgagtattgtcttgcagggcagtaatggataagtgtggtgatgctgatgattgcatctgtacttctgaggctgctgaacgatcatcaaaactttctgatgagaagattaagaatcttcctgtgcctggcgaagtagacttcataaatggcggacctccatgtcaggtcagttgtttttctctgactaggaaacattttatgcttgttttcgatactctaaaccaattgcataactttccatatgcatcctttttgcagggtttttctgggatgaacagattcaatcgaagtccctggagcaaggttcagtgtgagatggtcctagcattcctctcttttgcagattatttccgcccaagattctttctcttagaaaacgtcaggaacttcgtttcattcaacaaaggccagaccttcagattaacactggcatcactgctggagatgggataccaggtgcttactgtacctttctactaagttgttcttgcattctagcttttcgtccaacactaaattttgttaccttttcgtttacatgttctcaggttcgattcggcattctagaggcaggtgcttatggtgtcgcacagtccaggaaaagggcattcatctgggctgctgcacctggagagacccttccggagtggcctgaaccaatgcacgtcttcgctagccctgaactgaaaataaacctccctgatggcaaacactatgcagctgtcaggagcactgccgcaggggcacctttccggtcaataacagttagagatacagttggggatctcccacccgtggaaaatggcgccagcaagccaacaatacaggtatgtgtcagtgtcactgcaacttaatctccagtcgctttcttctgttggtgcccttggctggtagtatcagctggatttactccttcctatggtgcagtatgggagtgaaccagtgtcatggttccagaagaagatcagagacagcaccgtgttgctgaatgaccacatatccaaggagatgaacgagctgaatctcatcaggtgcaagcacattccaaagcgacctggctgcgactggcatgagctaccggatgagaaggtaaccacagcctgctcctttgtccaccagtagttgttttatactacctttgctctaggtaaccatgccccatttgccaatgcttatgcgagtacacaggtgaagctgtcaactgggcaaatggtggaccttataccctggtgcctgcccaacactgccaaaagacacaatcaatggaaagggctctatgggaggctggactgggagggcaacttccccacatccgtgaccgatccccagcctatgggcaaggtcggcatgtgcttccaccctgagcaggacaggatcgtcactgttcgtgagtgtgccaggtctcaggtaatttgccttcgcatgtaccatatagatcattggttcctcaatagctgctgcaattcagtaacagtaatcaatcaattatttaagtgttttaatcagtccatttttagtatctttggcctgctctagcattactgtttgaattacttaacaagaggcagactagacttcagagcatttctttttgaagaacttcagagcattcatgtgcaaattgtctcttaaacatcccaatcctattcacatgttctttgtacgcagggcttccctgacagctaccgtttcgcgggcagcatccagtgcaagcacaggcagatcggcaatgccgtgccgcctccgcttgcctacgcgctcgggaggaagctcaaggaagccatcgacggc

SEQ ID NO: 802 - DNA, 7275 bp, Sorghum bicolor
gagtcaggcactcactgatctccacctggaaccatggcatttcttcttcccaatggtttctatattcttcatcccattttccttcctctccgttcatcattgctttctcaaatcttccctgaatccaaccaaatttcttaaaacaaaagcgtacctgtgcatttttgagctccacacacggacacttgaaaacaagctctatgagcatcttcttccctatcagactgggtgatgcatggcacaaccttattgaaccatgcctccactgtcctgttctccaaccttgctgcacacctgtcatttgtatatgttcatcaaaattcgtataaacccccattgtatcaatgccaattccatgctagttaaaagataactgcatggagttgatgcttcttcccacaatgtagtcttcatgttagagcacctaggtgtggcgttcccctcccgggttcgagcaacggtgtagatggttctgtggccaccaatgaagcaagtttacatgaggttcttgctggctttctaaggttcggttggtccctaccttaagactaagtcaatgggacgtctctctccttgatcaagttagatggaaatggagtcatcccagtctcctacagtctgacccaaatatttttcctgagttgtgacaaccagtgttgccaagacatctgtgtaccttttcttttttaaaaatgtcaaattagacgcccacacccgtgtcggatgccgttggatgccaatacccgcactagcatttgtgtcccatgtgacactggtgacaacttgctgctaaagtacttggcatttgtgtgcttgtttatccacatgtaacggtagtgtcagttgaggcagaatcttcctttataggcaaagcatatgaatcgataataccatattttcctttacaaatttcacatgaactattggggttgatattgcaactatgataacagaggtatgtcgagcgttcagtaagattcaagcatggttcggaacctatttcttttctctaagggtagatgggtagattaattacataggctctatggcattccagtggctaatattaccttttctttctattcttggattgggctgaatattaattgtctaccttttaggacatggtctcctgatgtaatgttgtggctcatgtagttttagagttactaaaggagcactatttacaggctacagctccattttttaccacggattatattttggaagaaataaaggcgtttctaaatgatcttttgtcttaaaatattgtctttgttgctgcacttcacaggcctatatttttctagttactgatagcaagcattaataacggtttgacgtttggtcaatatttattctgttccttaaatctagtcattcatccaagccttccctttttttgttgaatttgtgttttggctgcctgagtgtttcttttcttcgtgttcactgttcagtactgttattttaacttttgttcccccatagctgattgatatgctgaccaatgaattttcaggaacaagaagatgcagagcaaagccacaaaagaaggaaaaggaatccacagaaaacagcaaactggagaatggatctcaggatgcaacagaagaggtgcatcatggagtcgaaaaaggtgatggacatgttacccgcaagagaccaaggagagcagcagcgtgttctgatttcaaagagaaatccatacgcttatccgaaaaaaaatctgttgtcatggtcaagaagaatcggatggaggaagaagaaatagatgctgtgagtctgacaaaacttggaccagaagatccaccaccttgccggaagttgattgatttcatcttgcatgatgcagaagggaacccacagccctttgaaatgtcagaaattgatgacttcttcataacagctcttatcatgcccatggatgatgatcttgaaaaagagcgtgaaagaggagtacgatgtgaaggatttgggcgaattgaggactggaatatttctggttatgatgaaggtactcctgtagtctgggtgtcaactgatgttgctgactatgaatgtgtgaaaccagcaaccaattacaaatcttattttgaccacttctatgagaaggctcaggtctgtgttgaagttttcaaaaagcttgcaaaatcagttggtgggaatcctaaccagggtctggatgaattgcttgctagtgttgttcggtcaattaatgccatgaaaggatatagtggaaacatgagcaaagatttggtgatctccattggagaatttgtatacaatcaacttgttggtttggatgagacatcaagcaatgatgatgaaaagtttgctaccctgccagttcttctttctctaagagaccagtgcagatctagggtggaactgaccaagctgccctctaacatctcgaacacgagtctgaaaattaaggacacagtgtgtgaagggacagcggaagaagaagatgatgatgcaaaattagctagattacttcaacaagaagaagaatggaaaatgatgaagaaacagaggggtaggcgtggaacaccatcccagaaaaatgtctatataaaaataagtgaagctgagattgccaatgactatccccttcctgcatactataagccatttagccaagaaatggatgaatacatatttgatagcgatgacagtatattttctgatgatgtgccagtgaggatactcaataactggactctgtacaatgcagattccaggcttatatctttggaattgatccctatgaaatcaggagcagaaaatgatgtggttgtctttggatctggtttcatgagagatgatgatggcagttgctgttctacagctgagtctgtgaaatcgtcgtcttcctccagcaaagctgaccaacaggatgctggagtccctatttatttgagcccaatcaaagaatggcttatagagtttggtggatcaatgatttgtataaccattcggactgatgtggcctggtaagtaccctcatctactttctttcagcacactgcttcattatgcagtcattaactgtgttcttagcagttgtagcactgaatcctttataccgtttgaacataactttaagtttttttttcatctttactccattacaccttacgtttagagtgtgatttcaggtacaagctacgccaaccaacaaaacaatatgctccatggtgtgagcctgtactgaaaacagcaaggcttgctgttagcatcatcaccctgttaaaagagcagagtcgtgcctcaaaactttcttttgctgatgtcatcaaaaaagtagctgaatttgacaaagggaatcctgcatttatatcttctaacatcgcacttgttgagaggtatattgtggtgcatggacagataatattgcagcagtttgcagattttccagatgagactatccgccggagtgcatttgttagtggtcttttattgaagatggaacagaggaggcatacaaagctagttatgaagaagaaaactcaagtaatgaggggagagaatctgaatccaagtgcagcaatgggtccggcatcgaggagaaaagcgatgcgtgcaacaacaaccaggttgatcaacagaatctggagtgattactatgcacatcatttccctgaagattccaaggagggagatggaaatgaagcaaaagaagttgatgatgaacaagaagaaaatgaagatgaggatgctgaagatgaagggcagattgaagaggataagatctcaaagactccaccatcaacacggtcccgaaagttgctatcacaaacttgtaaggaaataagatgggaaggtgaaacatctgggaaaacatcgtctggagaaactctttacaaatgtgcttatgttagagaactcagaatacctgttggtggaacagtggtgctagaagatgattcaggagacacagtcatgtgttttgttgagtacatgtttcagaaaagtggtggtgcaaaaatggttcacgggaggattctgcaaaaaggttcacataccattcttgacaatgctgcaaatgagagggaggttttcttaactaatgattgtttagaattcaaattagatgacatcaaggaattggtaagtgttgatatccaatcgagaccttggggtcacaagtatagaaaagagaattctgaaactgataaagttgagcaggcgaaagcagaagagagaaagaaaaagggcctgcccatggtatatttctgcaaaagcttatactggcctgagaagggtgccttctttgccctcccccgtgataaaatgggtcttggtagtggtgtatgtagttcttgtgaacatatagagccagattctgatgaattgaaagtactttcgaagaccagctttgtctacagaaaggttacatataatgtcaatgactttttatacataaggcctgattttttctctgaagatgaggatcgtgcaaccttcaaggctggccgaaatgtgggtctaaagccctatgcagtttgtcaaatactggccatccctgaaggagctggatctaaaaaactcaatccagcatcagcaaatataagtgctagaagattttatagaccagatgacatttcgacagccaaagcctatgcatctgatatcagagaggtcttcttttttctatcttatatgtttgatttatcttatccaaaatgtcattgttactttattttctcaaacatgtgtgagcaaatcctggagtcctgagaatggtcattcttgtattcttgttaactttgtttgtttcattcaggtctactatagtgaagatgtaattgatgtgcctgtggatatgatagagggaaaatgtgaggttagaaagaagaatgatcttgcaagttcagaccttccagtgatgtttgaacatgtatttttctgtgaacttatatatgaccgtgccagtggagctctcaagcaggttagctgtactgaagttgctgttctgattcattgactgatacttttgatagttccctgaatgtgtgttctgtgtctggagcagttgcctccaaatgttaggtttatgtccatggtgcaaaaggcaacaattgcttcgaaaaagaacaaaggaaagcagatctgtgagactgatcaaatagattcaggtaaatggttggatgtgccaaaagagaaccgtctagctacgcttgacatttttgctggctgtggaggtttatcagaaggtctgcagcaagctggtatgtactgttaacactaatgctgtttaccatgaacatgatgaccatcagaaaatattttcctcattgtccaatgctgcaggtgtatcttttacaaaatgggcaattgaatatgaagagcctgctggtgaagcatttagcaaaaatcatccagaggctgtggtctttgtagataactgcaatgttattctaaagtaagtgcaaattgtttgatgccattattatgcttttgttgcagaacagaaccaatatttttgataatgcagggcaattatggataaatgtggggatactgatgactgcatttcaacttctgaagctgctgaacaagcagcaaaacttcctgaactgaacattaataaccttccagtccctggtgaagtagaattcataaatggtggtcctccgtgtcaggtttgttattatctacagtaggccagaaaatcatcagtcacctgttcagtttcgtaaatcaaatgcttgaattgttcattcattgttttcttatcagggattctctgggatgaatagattcaaccaaagcccttggagtaaagttcagtgtgagatgattctagcattcctctcattcgcagagtatttccgtcccagattctttcttttagaaaatgttcggaactttgtttcattcaacaaagggcagaccttccgattagcagttgcatctcttctggagatgggataccaggtatttcttctgttcattcattatctgctaagacctatagcttacaccttttgttttgtagtggtttaaatctgtatactcagaaattgtttgccatttggttaggtccggtttggaattctagaagcaggggcttttggtgttgctcagtccaggaaaagggcattcatttgggctgctgcacctggagagatgcttcctgattggccagagccgatgcatgtgtttgctagccctgagctgaagataacactgcctgatggccaatactatgcagctgccagaagcactgctggtggagcgcctttccgggcgattactgttagagatacaattggggatctgcctaaagtggaaaatggtgccagcaaactcacacttgaggtaactgctgctctgaaccatctattttcatttttctctattagcatgctaaatgagctactggttgtcttgtgcagtacggaggtgagcccgtgtcctggttccagaagaagataagagggaatatgatggtactgaatgatcacatatccaaggagatgaatgagctgaacctcataaggtgccaacacattccgaaacgaccaggttgtgactggcatgacctaccagacgagaaggtaatgttctaaaatctgttgtcatcttcattctgtccatggagcactgacccatgctatgctttacaggtgaagctgtctaatgggcagatggctgacctgataccttggtgcctgcccaacacagccaagagacataatcagtggaaagggctgtacgggaggctggactgggaaggcaacttccccacatctgtcacagacccccagccaatgggcaaggttggcatgtgcttccatcctgaccaggacaggatcattacggtccgagaatgcgctcggtctcaggtaagctgctctacattcatttccatcttcaaagaaatgataatgaccctcgggattacctgtcaaatatgatccaatctttgccgtgcagggctttcctgacagctatgagtttgcgggcaacatccagaacaagcaccggcagattggcaatgctgtgcccccgcctcttgcctatgcgctcgggaggaagctgaaggaagctgttgacaacaagcgtcaggaagctggcgtgggcgtccctgcaccatgagaagcttcccttccatggctcatgaagccaaacgctgaggtcgtctttagaaacagcgaagggcagagtagcctgtgatgtcatgtctaaactgcagtaacttagttaatcatggtttcagtcttatggaccccctgagtgtatatgctagcgaagtgttgattg

SEQ ID NO: 803 - DNA, 19373 bp, Sorghum bicolor
gtagcatgttttcctttttgagatgtctttttatttggagttgctttagcccgcatgtcacacgcagtcaagtctgtgtgcacaccttctcctcccccgcatatcctcttatttctcctatgacacatccccacaccctcacccccatcgcctcaacgtgtgcgcggtagggtctcactgaagctccttgaccgtagagctctggtgtgcccgtgtcggctttctcctcccctcccgccgtcgccatttccacaggctctcctatccctaaactctaaaccctaccgcatccgtggcagtcttctcctccagcggagctccgacgtgaacctaccacgcctgcgtcggcctccttcttcccctcttgccgctgccatggctatagatgccccctaaaccctaatccctaaaccctaaatcctaaaccctactacgcccgtggcggcctattccttcccctcttcccttcttctcgccgccaccatgcccatgcccaccccaccctgctctggcccgaccgccttccccgccgccggaaccttaacaatcgaacaacagagaaggtgtgcgagcagagtgaccaaattctgtgtggaagtaagcattcttgccttttattttatctttttttcttttctgtctagttcctccattccaaaatcatttttttcatgagtttttttattttattgaattgatttttcttcgatctgcccatcacctccattccaaaattgttttttccattccgccctcccgacacctcctttctttcttctacctttatccacagatatcaaatactcattttgttctcaattataagccgttttgattttttgatacatccattgaacaaaaaaaaagttaaagcgacttataatttggaacggagggaataccttttctaaatatcatgttttgacctttttttctgttttccccacaaatgtcaaaacaatatggctgcttataccagttctgttatatgtcaactgattggttcatagctaaactgggctatgaagtctcaaccaataaagtggcgaaataccgtcgaaactcatatacatacacatgtacgctacctgtaagatacacggtaggagtacattatctatgatggacttaacatatagagatttttttctgaaatagaaacatttttgggaagtaataaaccagtacaactatgagccccgggcaccatcagtgaaattcaatcaattcaattcagtagggtaggccagcccaacccttctctgtcctgtggtctcgcactggcgtgcggcgtgcggcgagccggcgaagccaggggttacggtacgtcggtaccgagcggcggcggcctgcgggagcgggagtcgtcgagtcgggtatccgggtcctgctggtcgagtcgggtcagacgtgatagaggagggacattccaggctgcgcacagtgcgcacgccctgcaaatacacgaaccccgagccgggggccgaggaaaccccaaaaggagattctcctcgccccttccactagagcagccgacggcccgaggcggcgagctcgtcggcgactgaccaccgccggagcagccgccgcctcctgctgggcctgtaccacagctcgcacgagcggctccggtggctgcgccagccgccactgtgctgtcggagggcggctcggaggacttgcgccccctcggcttctctgcgcccgccgcccctccgccggcgtgatcgaggtgagtagttcctcgcattcaatcggttcctgatccccgcgtggtgcaatgcttgggcgcatcgcttattcgcttgattcctgttttttttcctctggtcgcggggtttaatcgcttgattcctgtccttttttgctctgatcgcggggtgggattttttcattttggcttttgctccgtctcgccgtgctgattgccctgttttgccgggtcgggcgtttgcggccgtccgaggtttgggctggtgaactgaagttccccaaagcagggttttagcacgtgctctcttccaggtatagcatacgtgatagggacagagtaatggcttgcgacccgaatggggtcggctagtgtctttggatcccgagggtaagatttttggtgctgttttccactaatcgcaagcccatgtccattgcagaggatgatcgagtcttccatgcttcagcagtcgaatatatatatattttgatttctgaagggctttctcgaatccccaggcatcatcaattttattgggatgcaatagccgtagtcatctccgtgtactccgatgtttagagaggcacttgcctcagcctgctgcgagggcatgcaaaacttctgaggcgtgagctggtggctgacaagctctttgccgtggcagagtcagcgattcgctaatctggtgatctatctcttaaaacttagtcgttacttgaaattgaaatgctcattcgaagttagtacattcgtggagaagtgcttcaaggtcagaatgtagctctaaaccttcattgtctgcagagttcagaagccttgtttaatgttgtgggaaaggaataacccttctgtggttgtaagaaagtgaacgtaccataggtgataggagcacagtgctgtcagaacttggcacatgtagcagcttctcagggcgagtgatttggaatgcttgctattgtatttttctttgctaatttgttaactttggtattccaattggaggttttcatgtgtggaatagttaatggagcagttcatagaatggtgaacccaagaatttttagaagcccggacgatttaatgggctaattaacgatttagacgttgtcccctttctatgtgggctacttaatcattaggcctaatggccatgaacggtgaggaaccaaggcagagaggctcagggtcgccgggcgctcgctccaccagactttctttacaattggttaaaactggttgttttattactgccgcagtttgtcatggtgattttcttttcgagtgagtcatggcgatatcttttaaacgagtgagtactgagtacggtgatgttttaaatggaatatatggatgcttgtgatattggtgtgtatacctggtattatttcttgcatataacatgtattacgttagttttaggtcctgtgatctaagaagggcagttagtgtttttttttcaagcacttctgtttcatcaagaggagaggaagtgatccaaaaagaatacagtacattacagttaagatgcactccagtgcgtaaagcgccccgacaagaagaaaaaacaggggcgggtgtcagttacacgacataagctggcccaccaaaaacagaccacgaagaaatgaaactgccaaaccaaagggcatttgatgttatcaaatttccattttaaagtggtgctcttcagtaatttttctccaaattatttcatggagggatcttgtgatgctataaatatttgaaatgctccagttcacgatgaagcaaagttatgtggtctagcgggtgccaggggcatagccttgctgactgaatggatacttggtgttgcctaattgcttggctccttggtcgttcatcccttgtttgtgagtgagtgtgtgtggatttgttgtgtctgtgtctgagagtgtttgtttgtaagtttgtgtgggcttttgtggccgtgtgtgtcggggtgtgttgaggtgttatctttgttgttttaggggtttctcgtacccccttttttccttcttaatataaaagatgcgcagctctcttgtgtgttcaagaaaaagaagtatttgaaatgctgtgtagtatagccagcaaacagtaaacaaactaggatactcttcatgcttgcattgttagagtgagatttatcatttaaggcgtcctatcatcattatggagtcttcttttgtgtttactttttcattaagactaattactatggattgaaataactgtatttcaatgtcatattcagagttatgctgtacttcttgctgttacactaatatttatggtctgttattccttctgtttggtttctacttctctcagaatgaactatttgccatgcgactcctgtgcaggatggagctacatcgtgaacttcctgaagctactctgaatgccataaaatttgatctcatgaccagtacagatatggtatgttttgttaattttgcataaattctactccccccccccctctctaaattaaagtgttgggcatcattacacttttatactttactttctcctttttgtgaagagcaagtttctacaacttatactctatatgcttctggtcatctatgcaaatgcttattttcttatcaagtcagcacatagagtaatttgattattattctattcattgcattgtgttgtcagagatagttttatgcaattttacgttcaaaaataattttatgcaattattttaccatttcaggaaaaattgagtagcatgagcgtgatcgaagtgagtgatgtcacaagtcccaagttaggactaccaaatgcttcgccgcagtgtgagacctgtggatcgaaaagtggacgcgactgtgatggtgagcacacttgcctaaaaaagtgatattaagcatgctacgttgaagcatgtactttgtgtgcatttttttgtgcaaagagaatcaacttgtcaaattttttagggcatttcggtgtgactaaactggcggcaacagtgcacaatccatattttatcgatgacgttgttcactttctaaaccaaatatgtcctggctgtctcagtccaagggaaggcataaatatgaaggtttgtaccttcctgactgacctatttttatcctcattaagcactacatgttttttctctttgccaaagttcattgataccataatttagtcataaaatcactttcagattatctggctatttttcaagagctctccttgttcatctgatgaactaaagtagggctagagagtcctagacacagaataagagactgcaaaacaaatatcagtattactacatgcaattgtgctattcattgatgagtttgtttgctgcatgttacctctcatgtaatcctttacctatttatttcagtaggtattgattcacacgaaaacagtataaagcttttcaaaaaaaatctgtatatcagtttgatgcttactagctcagtaagttattattctctgtattgtttcttacgttagttaccttttcctgaaaataaatataatataataatttattgtttgcatcaaagtttaattcgcaatacatttgattactttgtgaattgtactaatagttaatcatacagttgaactaacttagctgaaattttttaaatagaactcttatatttgtataattgcctagttccacttatggacttattgatgttattcaactgcttataactgattttaccaaaatgttctatttagtttttaacatggaaacacatggctaaaagtagcgtcctggctcagtttacttatgttttggttggtaatgttatgtttagttccacaggttgctcttcatgtttgggtaggatatgcttgtgttaaatgagcttcagaaataggccatctttgtatgtggcataatagggtacctatgttccttcattgtttatgtttcctcttgtgtaatcctgcttctggtattccaagggttgctcctttcaggaaaagtagggatagacttgagtttatatatagtattatgcctatttcattttcttatcatggttttatcaattcctaaaactattagaggtgctcttgttatgacactaatgtttacacatctataatgacccaatgaggcaatgacccactgttaagtaaaaaactatgcctttctcttataaatcactctttgctttattgaagagattggggagagaaacggttcaagcaacatcaacatgcaagtattgctcagtaagtgcatttttagttctatcgatgcatatttttcccaccttgtattaaatcttgtgtttttgctggacagaaggatggctctaaactttaccctagcgtaatctttaagacgctgtcaagtccaagagtattattgtccaagagtaaacttcacagaagccctagcgtgatggaaagaatttcaattgttgcagaagctgctgaaagagtgtctaatagatcaaagggtaaaggtttgcttgaaggcctgccccaggattattgggattttgtaccttctgagaataagcaagtccagtcaaatatgaccaagataatattgtcgccctaccaagtaatttttttttcagaccttcatctttggtaaaggctgttccatgttggcttccagtatatagatatactaattcactgtccccccccgccccccctgagaaaatactttttcctattatttttaattgggtcactgctactttggctcgagtaatagtgtcaaaaacaggtgatttaaaaacaatgtaggatacaaaaaaggggatttggagttactcatactgtttggagtatttgttatagattttttttattattcacaacatacagaaaacataattgtgattacgaaacaagggcaatgtggtcctcagctacttgtattcacatatttatcatgttttgaacagtaacacctgtccttgtttcattttccatatttgcaggtcttccacatgttgaagaaaagtgaccctgaacttatcaaacaatttgtttcaaggcgggagctattgtttctatcatgtttaccagtaactcctaattgccatcgtgttgtagaaatcggatatgggctttcagatggacgtgtaacatttgtaagcactattttttttgtttaatcttttatccattcatcgttttttctgtccattcatgattagtaaccttcttttcgtttagtgaaccctactgaatgctagccttctgtatagtttagagtaaatctttcaataatttttttgtaagtcatttaattagggcagctccagtgtgaaatcggttttgcattgcaaatttactgttgtggcagaagatgcggtgcatgcactgtggtgtttgatatataggacccaccactccactagagtggggagaaaagcatggaaaaaatagtttttctctctatgtgtctggtttagcctggctgagatgctgttggacacattctcacgctgcagtagctagttttttatccgccatggttcgacttatctgcaacatgcgattttgaatctggcagatacggttcgatcgctacaatgtgcatggttcgctttttcactcccatggttcaatttcatgatacactggaggtactcttaagagcaaatctactgtatatctttggagaacttcctcacctgatttgccatggattaagtcacttcactccatgccatcaagatttcaaatttcttcattccttgccattgccagattgcatggagtgtaaacttctgaaattagcattttaagttctttttttactccattagtgaagaaatagtggttaggactgtgtccgaaggagctgtctggtaattcacataaaaaaaaggagccgtctgtctcatggggctagtgtaagtcttgctccccagttattgttgtgtcaacatgctgtactgtccatggtatcactgctctaattttcttttttttctcagatgtgcaggagaactgtgtgtcattgtattaatagtagagaaatgagtcatacagagacccaaacacacacacacacacagccacttactgactgaaactaatcacctatgtgtgggtgcatgatgtgtgttcattgtctttgaatgtttatctttgttacctttttattccttctttaatgaaatgacatttagttttcctctgcattcgaaaaaaacagtgagaaatctgaaatctgaatggcttggagtgaaatctgatttaatcaatgacaaatcataaaaccagaccagaagttctctgatgtcaagtaatccattacctcttgaattaatgggagagcttccttgatcatcttggattcttgagtgcttggactatctgaatgcataatgattcatgcatctttgagggcgtgtttctggaggtccagacggtcgtatgtgcattttttgtggatgttgatctgtggagcgcatgcttgagctaggggttaacaaaacatttggccccaactagcctgcagtatgaccttagttgcgtggcgtgtttgattttctttcttcatctcttttgttttttgtttccaagggggatgatccacccttctaggcctatttcccctcctatactgaaacagcatgtagttcttgtgcatgtttgaaaaaaaaatattactagcaaacttatggggtacttatgcgatatggtgtgaaacgatttcttcatcgcactgccagatgcacaatctttttttgtcatttcaattttcaaaacgacatgttgtggcagtctcatccacttatctacatgctacagtacatatttgaaccatgtggcatctcaaatgtaaacacatgattttgttcattgcatgcttgaagtaggatgacagaacaaaggcttacaagaggatggttgatgtcagtaggagaattgatgactaccgccagcatccacagttcagtgttcttgcaagttcacttgtgtcagggcgagtctcagaatgcttaaagtcatccaaggcaagaaagctactatcttcttctttctatattgcaatatctatataggatgatataagtcattctgatctgtcggatctgggttcttagttaaaatcaagtgtttgaatgcaaatgattcaatcaaagtttctattttgtccatacccaattatatcactctaacctagatgttgttgacgaaccattatgtttaacacttctaattggttgggttatcactcatcagacaaaactatgttgttcttatttgagaatatctggtttattgtgttctacactctaatatgactatgcagctaagccttttccctagaacttaacctgactgcaaaagagaacggtagccttcttgaaagtgatcaaatgcatgtttcggaagtcggaactgttaccatgaaatcatgttaacattctaccatgaaaacattcaatacttgtccgatgtattcaaggagtatttgtgtcgattagtatcagaagaatatctgtatctgacatgtgagcactcataagtttccacttaaatccaattcaattgtacagaaggaacttaaaccttcaatttgttgaaagtcttaattgtcttcagagctttagctacctactccctctgtttcacaatacctgttgttattttagcctggccagaagaattgaggtagataaaatgactatccaacccgtggttaatcctccataaagtgtgaattactgcatttatgatgtcaaaagcacacattactctcttccatactagctaatgaagtaattgatgggtaggattgggaaaggttggtcaagttacctcaacattgtagaacaagtattttgactgaagtagaagaggctaaaacaacacacattgtttgaacgctagtaacaaaaaactttgttaagcgctagtaaaaataagttaagattctaatattacatttttggtgctaagttaagattctaatactacaattttggtgctagtaattctgtaacattattcattgacatttttatctctttcagttgtactctaaaaagacagatggggagacatctacagatccatctggaatgaaatggctaaaggatgctgttctcagcaaaagatcagataatgcttttaggagtactatggttggggacccaaaaattaagttatgggaaattggcattcctgaagatttagcctcaaacttggttgtttctgaccacgttaattcgtataattttgaaaatataaatttgaagtgcaacctgcaccttctaaccaaggaagaactatttattcggcgaaatggaaagttaatgtttcttcggaaggcagatcagctagaaattggtgacattgcctatagaccactgcaggatggtgatcttattctcatcaacaggcctccttcagtccatcaacattcactgattgcattctctgcaaaaattttaccaattcactctgtcgtatcaatcaatccactatgctgtacaccttttctgggagattttgatggtgattgtttgcatggatatatcccacaatcttaacggtacaggctcgagcttggagagctggtaagcttacaccaccagctgttgaatatgcaagatggtcgaagtttggtgtcactaacacatgactctctagctgctgcacatttgttaacaagtacagatgtttttctgaagaaatctgaatttcagcagcttcaaatgctgtgcctttcagtattaacgccagtaccagcagttattaaatctatgaattttcaaggttctcggtggactggtaaacaacttttcagcatgcttcttccttcaggcatgaagttcagttgtgataggatgttacacatcttaaacggtgaagtgcttacctgctcactggggtcgtcttggctgcaaaataacacgtctggtcttttctctgtcatgttcaaacagtatggttgcaaggcacttgacttcctttcttctgcacaagaagtattatgtgagttcttaaccatgaggggcttaagtgtatctctttcagacatgttctcagaccattactcaaggagaaaactaactgagggagttaagctggcattggatgaagctgaagaagctttccgaatcaagcaaatattgctagatccaattaacataccagttctgaagtgtcaggatgaaactgaagatgtaacttacagacaatctgattgtatccagaacaatccatcagttatcagatcttcaatcatggcatttaaagatgtcttcagtgatctattaaaaatggtgcaacaacatgttagtaatgataattcaatgatggtgatgattaatgcaggaagcaagggtagcatgttgaaatatgctcaacaaactgcatgtgttggtcttcaacttccagcaagcaaatttcccttcagagttccttcccaactctcatgcattagatggaatagacagaaatcgttgaactatgaagctgagggtactaatgaacgtgtgggaggtcaaaacctttatgctgtgatcaggaattccttcattgagggtttaaatccattggaatgtcttctgcatgctatatctggcagggcaaacttctttagcgaaaatgctgatgtgccagggacattgacaagaaaattaatgtatcacttgagagatatacacgttgcttatgatggaactgttagaagttcttatgggcagcaaatagtgcaattctcttatgatagtgctgatgatccggtagataaactcggcgccccagtaggttgttgggcagcttgttccatttcagaagctgcatatggagctttggaacacccagttaatggtttagaggactcccctctcatgaatctacaagtaatattctatttctgtttttattaatgtttatacttattatgtggacaccgctgtctattttttgtccatgtcatgatatatttaaatttgccgtgcaggaagtatttaagtgtcacaaggctacaaattcaggggaccatattggtttgcttttcctgtcgaggcatttgaagaagtatagatatggtctggaatatgcatctctagaagttaaaaaccatcttgagcaagtgaacttctctgatttggttgagacaatcatgattatgttagttagttcacttaaacattgtttttcctgtcatttaatcttataatgctatgcatttgattatttaatgttgcattttgttattagatatgatggacacgacaaaataagaaaagaaggaacttggaccacccattttcatataagcaaggtcttattcttcttttcttcttatgtaaatgaacagcgatttctttcttttatttggattttgaaattggcatataactatctgtttgacaggaaatgatgaagaaaaaaagattaggattgagatttgttatagaagaacttacaaaagagtataacgccaccagagatcagctaaagaatgcaatcccatcaatttgtatctcaaggaggtaagcaccaaacctttttgttaaaaaaatgcaccaaaaccgatttgtgtttcattgagtgtctatctatttttgcctctttctagcagtgttctttgcttttcactgcatgttgatacacatgtagcttatttcacgtccacttcttttttggacaaaataggaggggctttgcccctactggaaatatattaaacaattacaaaaaacagccagtcccaagaagaggggaaaaaaacgaaatttacaagaagctgtctagcctgagactgatgctaggaaagtaacgtttctgcgcgtgttgcaaaagaattgcgaattcatgtttaaacttagctttacaagcttctacacaggattggacttgtttgaatatccaatcttttgtcaccatccagatgctccgggctaggaggataattaaaattccataaagtaagggattgcaaggccatatttgaaagctggcagtcagttgcaaaagggttgtgaattcatgtttaaattcagatttacaagcttctacacagggtgggacttgtttgaatatccaatcatttgtcaccatccagatgctccgggctaggaggataactaaaattccataaagtaaggactgcaaggccatctttgaatgctagcagtcagttgcaaaagggcagtgcaagaacaaatgttccactgtgtccagtacacaatgagctattatatgtgggtcttgccattttttatgggcatatatgttatatttattgatgtgtaccaagaagacgggaaatgtttggcatttgctaactgcagattacaaaacgattatatttaagcaacattattaatttataatagtaatcgacccagaagattgaaaaaaagctggtggttgtaggttcttttttttcttgaacacacaggagagctgcgtatcattgtattaattaatagaaggataatagtcatacagagacccaaacacacacacacacacacacagagagagagagagagagagagagaaactaacaggacttaaaattttaggttctttttgctcatattttatacaatatatctccatctgaacctagcttgttgaattattagaattcaatgtgattctgattatatataaatactttctaactttttttagaatttgtttgttctggaaaaatgtcttatattaaaatagctagatccactgaattattgcatcaaaatcagcaacatgcttaaatttggatttgccaatagatgtcatatatggcacatctctacttattataatttataattctacagtcattgctattcacattctacttctttctttgcatctcctacactatcttttgacatgtttttctactctgcagaaaatgtgtggtaggtgatgagggtgttaaaatttcagcatgctgcatcgctgtcgtagcactagctgaacctaactccatgtctcagttggacactatcaagaaaagggtgattccaatcatactggatacactgctgaaaggttgttacgttttgataacataatataccccataaatttactgtgaatttcctgtagaacttagccacttaggaattatgatctgagctatagcctataggattcctttctaagctgtagtacatagaggtaaaatatttcgaggtgtagcttgtatggctttttatcattctataatatcacacatgattttgtagaaaaaaattgtattctcttaatcagatattatccacaaaatttagttgtcataggagtccataatatatttgtgattttttctctcaaatacacaggagggttgcgtgttattgcattaaagaagagagaatccaaacgacgcacagcacagagcacatgcccatatatcttaggaatgtatcaagtccaaaccagctgtttgctactacaatgataagtcactagatttaggaatgaaagtaacttaacaaatccttggagttgaattccaccctgttttatagattcaggcttactttcagcttgggaaaataaggtaggattttgttttaatagaaggaaataaagcaatttacttcagctagtaactaccattttttatccagttgagtccatgatggaaatatctgttggtggttgatgacattacagatctatatcttttataggaacttctcatgttgattgatgtccaaatgaataaaactggtaggttataaaacttaatatgtttgcactagatagtgggtactccctccatccctttttaactgttgttctcacatcccaagaagtcaagcatactcaactttgactaaatatagaagaaaatattaatatttatggtgcataattagtatcattagatagatcgttgaatttattttcataataaacttctttggagataaaaatgttgctactatttctataaacctagtgaaacttaaataagtttgaccagcacgaataccatagcgacacttaaaaagggacagagggagtttttaagttctttatgagagtgttatatatgaagctacaaataatgcccatgccaaaggttcaaaagttgttctgttatcacccatgacagacataaataagtcagtcaccaataaactaactgacttggcaaggaataaaatgtttttgaaacaagcaaggaataaaatgtgttaagcacctgacatacagtaagctataccaattctatgggtagttctgagaagtcttagcttccttcaaaagattattcttgtaactatagtgcggcagatcatcgggtgatgctttacagacttggggaagaaggaatctcatcagatgctctcaatttgatgatctgggagttcatactctggactgaagcttgtcaccagccagatcatgctatcatattaaagtttttccctataaagctgttacataccttagggatctgagagcataaactatccagagagatggtgatgagtatatataggtctagagagcctcatgggctggaccatatgggcctacaggcctataatataagagtcttcacagttaacaaaagcaacatttttaaagatttgcacttgtttctacatcttgtaatctggcccagatttcccttaaaaactgggccagtctcttctaataaaacaatggcaaagctttgctgtcctttttgggaaaaaatctgatagtacttacgtttggctgcttatcctctctttctgtgcaggttttttggaatttaaggatgttgagatccagtgtcaacatgatggtgaacttcttgtgaaagtttgtatgtctcaccattgcaaaggtgggaggttctgggctactctacagaatgcttgcattccagtaatggagttgattgactgggagctgagtcgaccaagcaacgtagctgatattttctgttcatatggcatagactcagcgtggaaatactttgttgaagtatgtgcccccgtatttgttgccattggttttcgttttcacttgatgaagatttataagcctgattgcctgttatcgtttcatctttagaattgattttaattgttatatatttgcagtctttgaaatcagcaactactgatattgggaggaatattcgtcgggagcacttactggttattgcagatagcatgtctgtaactgggcagttccatgcaataagcagtcatggtttaaagcagcagcgcactcgtttatcaatctcgtctccattttctgaagcatgtttttctgtaagtaccatgtgatttttgtactggtatgtttacatgaaaattgcttgtttaaggcctagaggcccattttgattttaccgtgctttcttcagaggcctgcacaaagttttatagatgctgcaaagcaatgttcagtggacaatctgtgtggaagtctagatgcaattgcttggggcaaagagcctttcaatgggacgtcagggccttttgaaattatgcattcgggaaaggtgtgtatgcattcaaaacatgctgcatagtgacagatgcacaatattttccatgatacacttcaatgcactcccagaaagtgataatgataattttgagggccttgatgcacatccatccataccagtatttacttgtgtggagttcagtttttgcagaaagattgatgcactatatttaataaatttcttctcaattccgtgcccatgcttgacgattgtcagattgtgtatggataaaattcaacaaagagtgtttgatttctatttttttagagtatcagtgttatctctgcttgatgtttcgatcaattaagctgatctcgtgaccgatgtagttttcaacattgaatttgaccatcaattaggctgctgtattttgttatgtagtcaatgaagaaaagaaaccaccatcttaaatatacctgcaggatattcagttatttaatttgttgctaacagttaccgtattttgcagccacatgaaccagaacaagacgagagcatctatgatttcctacgcagccctaaagttcagaatgttgaaaagaatcatttggatacgcgtagacaaagtactgaaaatgcttccatatgtaggttagcatgcaagtctaaaggcagtgcgactgtcaatggtgttgccataacttccgaccaggactttcttcatgctaaagtcagtatatgggataacattattgatatgcgcgcttccttacagaacatgctaagagagtaagaagacaatatcacccttgatggtgctattttactaatttatttttgcacgacttatgcataatgctttggtttcatagttatatgttgattatcatttatgtaatttcttttacttgcatgaaggtacccgttaaatggatatgtgatggagccagataaatcaaaattaattgaggccctgaaatttcatcccagaggggctgaaaagatcggtgttggagtaagagaaattaaggtgattatcaatgatacctgttcttttgaaatatttttccctcaaacacacacacatcattatattaagaagaataagaattagaagaagaagaagaagaaaaggtttagaaaccctaatagcaccaaacccactcacaccaaagagaataagtgtatacgttaactttgatataattgcgaaatcatgagctgcattagaagacatcatattttgattacatttttgtgtatatgtgtttgccatcgggccaagcttattgctaatatcgttagtgttagaaaattccattgacaagctgtccaattatctggaaaaacattatgtgcattaaaattgaatctttatacaatatcaacgtcagcctcctaagcactgtaagcttcccaaaggttgagcaaatgataatccttccgtacaaaccagaacaagatgaccatggtataatttgcatgtacgcaataaaaggtggattacaaccaggggcggagcctgaaggcacccactaacatcactacaatattttttagttaatatattgtttaatagtctatataataatataaaaaaaagatagatacatatttttgtcgtatatatttattgatatcttctagacaacaaaatcatacaaaacccaattagaataaaatattttgattcatctaaatttgtttgcctaccatattaggacacatgtaatgaaattttacattttagtaaatgtataattacatttcattatattttatattttaatgaacccgtactcaactagtaataacaattcattggtcatcaatactttaatatcatcaagcttattgagctgcacaatattatatgtcgattatttttttagtgtgaatcgcagtacagacacagacactcatatacatgcatgcacacccacccctgtaaacaaacacacgtcctaccccattatgagcaccttcgaaaattttgagatttgtgagtcaccacatgtggcttgctatggatagacacaattgcatatcacaggaagaatagcattgtcaaatcgtcaaatacttattggcattatagttattaatactttttatataatttggtctaagttgagatggattgactccttatgaagagagaacgatatctttctagaatggagggagtatactattaccgtatatgtatgtcatgatgcatgatttttcagtttgaatggccccgtatgtctaaatcctggctctgcccctgattacacctggcatatccctgtttattacaaaattgcatgctgtaaacttgatgtgaaaagtattaggcagtgaattgaggctggtatttgctgtcatttttttgatggtgtgaccatttgtcttgcatgcaggtcgggttgaatcctaatcacccgggtacaaggtgcttcattttgctcaggaacgatgataccactgaggacttttcttaccacaagtgtgttcacggtgctgcaaattctatctcacctcaactcggaagttatttgaagaaactatatcatagagcataagatacaacattagttgcaccagtgctcctggcaatatcttgtcctgatcagaccatattaccaacttcttagaaggaactagctgtcacattttaggatgctcaaattgctcaaaacaagtataataacaggctgtaagcaggctgaatgctgatgtggatgagagagaggggggggggaggagagagagagatagcttacagccatcagccggccgtattattagccctgctctcagagaatgaatcagcctaagatcatgtctctccctagcatgtattgaaactgaagggatctgatgctcctctgggattagggtgtatgtcaactcaactcaactcaatgggtctttgggattagggtgtatgtcaactcaactcaactcaattggactatggacggcgggcctgaaagagtcatttactctggtttcatgcctccatctctgtagtctgtagtatactagcctgcgtgtgtttcattttctgcgtgttttctattgtgaagatattctgacaccagaatatgatggcgtgaaataatcattcatttgtttgcaactgttggtggcacaaaatgcaataggtgttaccatcatcgttgtataattgcccctcaggcatgctactgcaatgaaccaatgatcattgaatatttcatgttgatgcaatttgaggtc

SEQ ID NO: 804 - DNA, 3165 bp, Sorghum bicolor
ttttcttctggcttgaagagtagatagatacattggactatttactggtatatgtagggatatggaagtaaagctaaaataaagtataccagtttttcaaattcaaccaccttcctctgctgtctgaatgattcatgagttgttatttaagagaagacataacaggatatactaagtcagtgctttagggaggtgtcatttcacactgaaatttattgaaatgcagctaatctatatccttcataagtgacttcaatatagctgacaaatatagcattagcattgaagtcagtcatatgcccttgttggcgcctaggcggacaccctctgactagagactagtcgcgcctaaggcgtcgccattttgaaccttgggttagtggatgacttcctaatttccaaccttgcttgctgctggtctggtgacagtgctgacactaaacctgtgttggctagatgagtgtccgctcatgtttcctgatcatcccagaacttgttgtttataggatattccagctctgtctgtcaaggaagtcaagacagcagatggtgcgattcgattagagttgagcgcacctcataagagacacatgacagaacgttcatggaactttcttgataaatatggatttcatcatggtggatgttctcaatttaggtcactgcttccagaagaggtgatattctcacgagtcattagttatgttttcaagagatttgttttggtagctttgatgaattccaggttgtttgaataacctacggattccttccttcattatttattaggctctgaatatattgaagaaggttcctgatgatactaggagaaagctagctgcacgtggatacattgttcagactgggtatgtgatgaagtaccttccagtacctccgaactgtctatatattccagagttcaccgacgggcagagcatcatgtcatatgtgagttttctagtacacgtatctggtagtttcttctacttcttgttgggtcctatctgatgtccggatttacttgcttctcatatcaggacatttcaatagctttgttgaagaaggttcttcagaaaatagaacaaatcaaaagatcaagatctggttcaccaaacttcgattcacatgatgctgaatcatgcgatttgcagcttgcgattggccagtacatacgtctaaggggcactacaagggtatgtggaaaactagataatttaaacctgtttacatggtgcacggaaaacacagtcacaatttgtttaaaaccactagaattactggaatccctgcacctctgcagtaccttattgtgctttattctgttttatagtgcacactggcatttatttctgatcaacctttttatttctaactgaatttttgtattctccacgataacttttgcatcttattttgaagggccctcaagacaacaccaagcggtttactgttggcagtgctgattcagctgcattgtcaacaaaacagtggttagaaaagatgcggacactgtttatcagcaaagggtcaggtttttcatctcgcagcgttctgacaggtgacccatacattgggttaggtgtagtagggcttccttctgaagtagctaagcggatgacctttgaagaacaggtcacggacataaacattaacagactgcaggaggtggtagacaagggactctgcttgacctacagagatggtcaagcaacttatgctataactgttggatcaaaagggcacacaacacttaaagttggtcaaactatcagtaggagaattgttgatggggatgttgtgttcctcaataggccgcccagcacacataagcattctcttcaagctttctacgcatatgtgcatgatgatcatacagtaaaaatcaatcctctcatgtgcggccccttttctgctgacttcgatggtgattgtgtgcatatatattatccgcaatcgcttgctgcaaaagctgaagccttggagctttttagtgttgaaagacaactaatcagttcccacagtgggaaggttaacctccagctaggtaacgactgtttggtagctatgaaggctatgtctgacagaacagtgttacacaaggaactagcaaaccagctggcaatgtttgtgccattctcacttctggcccctgctgtaatgaagccaattccgtcttggacaatcacacagatagtgcaaggtgcattaccagctaaattgacttgccaaggggacacacacttggttagggacagcacaatcataaagctggatcttgacaaagaatctgttcaggactcattcccagatttggtgtcctccatccttcgtgagaagggtccaagagaggctctgcaatttctgaatgtgctggagccattgttgatggagtttttagttctcggcggtttgagtataagtctgcgggattttaatgttcccaaggctctattggaggaagcacaaaagaacattcagaatcagtcccttgttcttgagcagtcaaggtgttctacgagtcaattcgtagaattacgagtcgaaaacaatttaaaaagtgtcaaacagcagatttcagattatgttgggaaattctctggccttgggttgcttattgatccaaaaaaggaagcctcaatggcaaaagtagtacaacaagttggttttgttggcttgcaactgtaccgtgaaggtaaattgtactcgaggcgcttggtagaggactgcttttcaagctttgtgaataaacactcagccattggagatgagtattcaccagaagcttttggtctggtgcaaagttcatattttcatggtctgaatccgtatgaagaactggtgcatgctatatgtactagagaaactatgatccgctcctctagagggctgtcagaacctggaactttgtttaagaatttaatggccatcttgagggatgtagttatatgttatgatggaactgtgagaaacatttgtagcaattccatcattcaacttaagtatggggaagatgatgaagctgattcttcaagtgctgtacctcctggtgaacctgtgggtgtcttagctgccacagctatctcaaaccctgcatacaaggccgtcttggattcctcccaaagtaacaatgcttcttgggagtcaatgaaggtagtaaagttataa

SEQ ID NO: 805 - DNA, 16449 bp, Sorghum bicolor
agtgctactatttatattttgcaaaaatttttggaattaaacaaagccttattttcacctctcaagagtgtactcttagcaacattttgatgtgttcatttatcatcacgcgttgccagtctactcaaacggaaagtgccagttaggccttggccttgtttagttacaaattctttttgcaaaataaacactataacattttcgtttgtatttgataaatattgtctaattatgaactaactaaactcaaaagattcgtctcgctgattacagataaaatgtgtaactagttattttttaatttatatttaatgccgcaagatttgatatgacagaaaatcttaaaaattttataatttttttggggaagtaaacaaggctttattatttcaatttgtgggattacacgatacggtttcgtcatcgagtcaggatagaggttgtgcaggcacaggttcgtggctgggtgggtctccctatgcagcaggatgcagcaggcacaggtttagtggcgcgggtctcgtatatccacactcatcatctcgaaaacgcccgccgcctgaactcgtctcgcccgcggccgatctcctccatccgctcgccggagaggagactgcgctcggtcgagcagcacctggggcccagcgtcctcgcgaccagctctggcgcggcgtccgccctctgcagccccggtgtccgcgcgaccgtcgctgctgtcctacttcgccactcgccaccttggccggagacgagcaagagcaacaccaggttttccttccccttggtcctcccttcctgctgcgcgaagccgtgcgcccaaaccctagcatactattcgtaatcgggatctgaatcttattacaggtgtatatgcttgtattatgactaccaacttcgattgttttgcaaaaattattgggtgtacatgtgtacacccatgtcctttactgggtccgcccattctgagagcctacaaaggacgaatgcagtttattttccatgattttttagggttcagttgaatccctgtgccccctatttcagtttcatttcatccccctggtgtcttttgatgactcgtcagtcggaacttactgtgaaaataagaatcattcagccttgtgctgacgtcttatgtgtgacaattgcccagtttcttcagtttgtcaagtgataggctgaagtttgtatatcagtgttttctgcttggatttctctgatatgcgctatcatttgctccttcgtttttatgcaactcactgtatactctgagatgtataaatgatttaacaccatcctaaggttgatgcacacaactttctggaaagatgcttcatgtatgctaattccccttgtgcctcacgactatatttttcatagatcattaatgccttactggttctggtttcatgatcttaacagtccactctgtcagtctgtctattgagacgattagtttccaactgactaatttggtgattctgtgatacttgatagggaatggaagagctacagaaggacggtgggcaacaatcaaatggctctgattctgaaccagaagctatggtgttggatgacaatggagcgggaaaatcccatagcatggatggaaacagggattctcctgtagatgtcgatgaaggccagtcatctatggatgtggatactaagggaaaaccatccctcaatgatgatgttaatggaaagtcttctgagccatattccaatgctccaattgacctgagtgtggaaagcctagagaagttttgcaaagaagcatcaaggtccttctttgatgaagttggtctgattagccatcagataaattcctacaatgactttgtctcgcatgggcttcaggagctttttgattcgctgggggaagtgattgttgaacctggctatgatccttcaaagaaaggatcaggtggctggaagcatgccatcatcaagtttgggagagtgaagcttgaaaagcctgtgttttggactggcaaggatgaaggttctgttgattttaagccttggcatgctcgtctccagaatatgacatatgcttcaagacttatagtagaagtgaatattcaggtcctgactattttcattcttttacatgcccattacttgttctttatatatgccatggttttcctaagaaaacatgccacctgggtgaactataaaatcagtgacgaggaaaaaaggtttacaagaatgcttgaatatgaatggcatgaccccatgttatttattgtagacaacacaaaattcagtccttttgttataagctaaacccataaaccaatgccttggccaccgagcaatatttgttggcacctgcacacaagcaccaggtgagcaggccctgctcaccttccctctccctcacccctgctccaaggaagaggaagagccctgagctccctcactcactcacgcagcacacacacactcagctttcagacttgaactgaaaactggagaactgaatgagtggcaatgaactgagtttttccattgcaataggtagggtatatatacacaagctatgtacctgctggtacactacttggatggtgactacaccactccaacaactacactacatggcttatctcagccaattcctactcttgtaccagcctaaaccagcccactactctagctggtgtacttctaccaactatggaagactaaatggcctatcgccatacttctacagtggcagccaagagctgaccacttgaacctgccgaatgcaggacaaaagtacaagagggacagcagattatatcttacaatcttcccctaatcctgctgtgtactcttgacctccaccatgccaatcttgctccttagctccaagaaccgaagtcgcccaactggcttagtgaagatgtcagcgagttgtcgaccagtctcaacaaactcgatgacaatctgcttctcctcgacgcaatctcgtaggaagtggaacttcacatcgatgtgtttgcttcggtcgtggagaacaggattctttgccagcgctattgctggctgattgtccactttgagcacaggcggccggggctcaatgcctgtgagctcccccagcagccggcgcatccacaccaactggcatgccgcggtggctgcagcgacatattctgcctcgcaagtcgacagagccaccgtcttctgcttcagcgattgccaggcgacaggtgccgcgccgaggaggatcaacacgcctgaggtgctgcgccgtccatcgacatctcctgccatgtccgcgtcgctgtaagccgcgagctccagcccgcctccaccagaccccccgcctttcgggaagacgagagcctggtccatcgtcccctggatgtagcgcagcacccgcttgactgccatccagtgatcctcccgcgggtcctccatgaaccggcttacatacccgaccgcgaacgcgatgtccggccgagtatgggtgagccagcgcagcccgccgacgatgctccggtagcgcgttgcgtccaccttctccgccgtgctctgcttcgacagcttgatccgctcctccatcggagtcgccgcaggcctgcaattctccatgcccgcccgctccagcaccttgcgcgcgtaggcacgctgccccagcgtgactgccttgcctccctgcttcacctcgatgccgaggtagtagctcagcgcaccgagatcggtcatctggaactttgccgccatctcggttttgaacgatgagatgtccctctcccgcgcaccggtgacgattaagtcatccacgtacaccccgacgacgagttcttccttcccccgtcggcgggtgtacagggcatgctctgttgcacaccgcgtgaacccgagctctgccatggtggcgtcgagcttggagttccacgctcgcggcgcctgccgcaagccgtagagcgccttcctgaggcggagcaccttgtgctcagccccctgtgcgatgaaacctggggcctgcttgacgaagacctcctccgtcaagtcgccgttgagaaaggcggatttgacgtcgaggtggtgaacagcccagtccttggccgccgccatggccaggacgagtcgcaccgactccatgcgcgccactggcgcgaacacctcctcgaaatcgatcccttctcgctgcacgaacccccgagcgacgagccgcgccttgtgcttcaccaccgcgccgtgctcgtccttcttcaccttgtagacccatttgagtccaatcggccggcatccagccggtggatcgaccaactcccaggtccgatttgcctcgatctgccgcatctcctccagcatagcgcgccgccactccggctcgcgctctgctgcagcgaaggtggccggctcttctgtgctcagcatcatgagctcctcctcttcgcccagcagccgtgctgccagtcccggagttgctgcatcaccgataacattgtccacacgacgaaatcgtacctcctcgccgtcgtggaaggcgtccacgaattcggtgacgtctggtggtggagtggcatactccacttgagccgtggtcggagtcctctgttgaggcggggtgccgcccgtcgtggtggggctgggcggctcagcttcccctgctgctggcgcctcgccccctgcttcccctgctccaggggctgctgcttcctccacgactccggttggtgcgtggacttgactggtgataaccagttgctcgacggtgaaggtcccaccgatcccgagcgcgccctcttctcccgccaagtcttcctcctcccacctccacttccccgcttcatcaaacacgacgtcgcgggacactgtcaccctcccggtgactggatcgtagagcatgtaggcttttgatccttcctcgtagccgaggaacaccatcttcgtgctccggtcttcaagcttggtgaggccgggcttggtgttcttcacatgcccaatgcacccaaacgtgcgcatgaatgccacgctcggcttgcggccatgccaagcttcgaacggtgtcttcccgctcagcgccttcgtcggtgctctgttgagaatgaacaccgccgtgctcactgcctctccccagaacgcccccggcattcccttggccttcagcatgcacctcgccatcccgacgatggattgattccggcgttccaccacgccgttttgctgaggtgagtagggcgccgtgagatggcgctccactccctcctccgcgcagtaggtggcgaactccaccgccgtgaactcccctccacggtacgttcgcaacacccgcagtctcctcccagactctgcctcaaccttcgccttgagttgcttgatggcttctgctgcttcgctcttactggtcaggagccgcaaccacatgtagcgaccgtagtcatccaccagcaggaggaaatacctccgccctccatgcgtggccggggtgataggcccgcataggtcaccatgaaccagctcaagcttctccttggcgcggtacttcgcctccttggggaacggcagtctcctctgcttccccaccaggcagctgtcacaaagctcgctggcgtgttggatcttgggcatccccctcaccattgccgccagtctgctcagtgcgtcgaagttcaaatgcccgagccggccatgccatagccacgactcctccgtgcactgtgccgccaggcacactggctgctcgaccttaagatccagcagaaacagccggttcttcgaccttgtgaccttggccagcaaccgccggtcttggtcacggatccgcagcactccgcccttgatcaccacctctgcgcctcgctcgtccaactgcccgaggctgatgatgcttgtcttcggatccagtagacatctgtcagcgcccgatgttctccgttccgacaccggaacaggacagtgcctcggccgcggattgccacccgggagccatcgccgaacttgacgctcccggtggtttcttcatcaagttcggagaaaacagcgcggcttcctgtcatatggttgctcgcgcctgagtcgaggtaccacctctgctccagctcttcgccgtccgctcccaggaggacacgcgcgcgagactcgtcaagttcgacggcctgcggcgcagtcccctgcttcgcctccgcctcccctgcttcgccttcctgcagcgcgcaacactcccccatcaacagagcgcactcgtcgtcgctgtcgtcccgagccaagtgggcctcctccttcttctccggcttcttctccgggcattctcgtgcccagtgccccaccttcccgcagcgcctgcaggcgttggggtcggcgttccttttcttcttcttcttgtccgccggcggcttcccgcgccccttggcgccatctccgccgcggctggtggagccttccccggtccggcgcttgtccttcatgcgcgcggtccactcctcttccgtcaggagtagcttgggcttctccttctctggtgccggcgtgatgcggctctccgctactcgcagctgcccagccacgtcctccagagacaatgtggagatgtccaacatcgtctctatggacatggcgagctgcgaatactttgccggcacggtgcgcagcagcttggtgacgaggtcctcgtcgtccaccttcttcccgtaggtggccagttgcgtggccagggattgaagacgaagagtgaactcctccaccgattctccgggcttgaacttaatgtcgttgagctccctgcggagctgctggattcttgcccgcttggctcggtccgagccgacacgcagcgactccagcatctcccaggcctgcttcgcggtctccttggcgcccagcgcctcgtggtattccgccggcgtcgaggccatgagcgcctccatgactcccacctgggcgtcctcagtgcggtcatcctcctcaatcgcccgccaccacttccgcgcgcgcagcttccacttcatctgcatcgcccactcaccgtagttggtgcgggtgagcatgggccaagagccgctgccaccgaactccttcaccacgcgcacctccacctgcggtggcgccggctggagctgacgctctgcgccctccccgccaccattccggcccgcatcctccgccattgctggtcgatggacctagcacacggcttgtactgctccgataccaattgttggcacctgcacacaagcaccaggtgagcaggccctgctcaccttccctctccctcacccctgctccaaggaagaggaagagccctgagctccctcactcactcacgcagcacacacacactcagctttcagacttgaactgaaaactggagaactgaatgagtggcaatgaactgagtttttccattgcaataggtagggtatatatacacaagctatgtacctgctggtacactacttggatggtgactacaccactccaacaactacactacatggcttatctcagccaattcctactcttgtaccagcctaaaccagcccactactctagctggtgtacttctaccaactatggaagactaaatggcctattgccatacttctacagtggcagccaagagctgaccacttgaacctgccgaatgcaggacaaaagtacaagagggacagcagattatatcttacaatattgacgtgcctgcatttcatttgcttgaatttcccttgcaccctaatcagtaatcagtatagcatagttctaaatgattgaatgttaaataaagcagcctaggactggatgggtgattggtgttttgaggacatccatcagtcatcagcactatagttattcttgttttctccatttgctggattccatttgaagagtctattacatttacttattccttatgtatgatgaagctggagacatgtagtcaccttggtacttgttttggtgtcataatgttactcccatttgcttaggttttatggtcacctgattatctgttatttttcattgtaccaggtttattctttggagaaaagtgacaaatctaaaacaggaaatgatggttttgttcaaaaaagggacttcatgaatgaaactcattggatatttattggcctccttccggttatggtgaaatcaaacttatgtttgttgcatagtctcaaggaaagcgagtgcttgttcgatgcaggtggatactttttggtcaagggaatggagaaggtaataactctatgatatctgttgttaatgtattatgtaggatgatttaattattagctttcaagtgtccttttgttgctgggactatttgggctgtgagctttcttagaacccagtcagcaaatttgtgtaatgtgcattactggtagctcataagagggagaaaaatgtctaaatatgattgtagctatataaacacgacaatctatcgtatcgaagaaaactttggcacaacagtcatttgaggtggtctcctcctggtgccatatgctagcttcttgtgtttaagctatatatataagtctaaacctatgcagcaagaggcagatacggatgtgcggatactgcatttgtctaaaaaaaatccgatacacggatacattttatgatttttaattaaataaataataaaacattaaattataaaagcaatagcgccaaaagaaagttcgagtgttcgacattaccctgcaatattggtgttttcctcttttccaatttttgaatcaaccaaaagtccagataagcgtctgcattcactaatttccaaataaagaagttcataaatcactgtagtaaaacatagaagttcaatgtatgagctctggccttggtcattggcgtcattggcatagaagtatagaacaaagcactagcaccagtactactcgaatttgttggtgatgggtgatgccatttgccatcttgttgcggctgggaaaaattgtggagaaaacacaacagagtgcgctagatcaggaaggtgaacaaggaaaatcaacagaggtcaagaaccgaagaacatgactaaatcgagaatagaaagccaacaagagggttgtcgttggcttgtcactgaattgctgctaggggcctgtgcatgctgccgaggtgggggggggggggatggtggaggttcgtgatcggtgggctggggtcgtcgtctgtgctgcccttgtgtgtgctgcaactgcaatgcgggcatggcggagcttatcggtggcagcggaggtgtgtcgctagtgtggcggaggctcgttgctggcagccagcgggtaggagtgcttgtccgtgctatgttgattcaccggtgcacgggtgtgcgggcagcggcacgatgcagcgaatgagacagaacagtgcgggagtggataggatggagtgtcggaggttacgtattgctggtgcgtatcaacatttgttgaatttattttatttccaatatgctgccgatacgtattggagccatatccttcgcatatccgtatcatagtcacaaagtttctaggtcgatggggtcgaggtacatggtacgatacttgcgagttgcgagagatttttacactttgggtcgaaaatgaacccgtgaacccaggccagggtcgacgaacgcgggtcaagggtcaaaggtgatgaacccgttttatgtgactatgatccgtatcagatacgtatctgataagggatacactgcccatcacacatatccacgcaacacaggtctaaactatgcagcacggatacgatatgtgtatcggtatcagaaggatatggatacggcaatttcctgaaaaaaatccaatacgtggatacgttttactatttaaaaataaaaaagataataacgcattaaaattgataaaacaataaaacattgcaatctacttaaatacttaagttctattattacagaatagcaggtctcaagtctcaactctcaaattctcaaatatagtagtctgaaatataggagagtaataaaaggcatccaggcttgcaattcaggctcgcatcaagttcctgtttcctcatttgtttcattctcatccacaatatcatgccacagatcacccaaaccaaaaggcacagcttgcaattcaggctcatcaagggggagaggtcagccacttcgagaatgccaataccatcaaggcaccaagtgaatcaaaagaatctcctcccacatcccactgtcttgtatgcatcaattcttcttgacagatgcctcagtggggagcaaagaaatcaagcaacaatagagtagattgagaagtgagaacagggaaggggatgaactcacggccgtcatgggagaaggagggttgatggatcgatgtcgcggaggcggagactcgtcgccggcggccggcgagcgggacgaggcatgcgtcaccgcctgagtttctgggaggcggcgcgaggttgcgggcgttccagcgtcgggggcatttggagatagcattgcttgttgttgggctggttcatatccaacatgcatacgtatcgggccacgtactcaataatcacgaaaataataaaaaattggatactctgcagatatcggtcgcgtgcgtatccgatacatgttacgaaccctcagtcacgtatccatgcaacacagggtctaaatgagctgtagtgtgttatttagtcatatcttggagattctaatagacttcaaagttcccgtgataattatttacaggaatgctgacgatctgctgatgacatactcagataccatttcatgatttcactatttcagatacccgattatttgctaagttcatttggagtttccttttgggtgtgactatctgcgttgtagcctttttactgcaaagagaatgccctttgaatcacatatagtatttttctttcattatgtttctattgttgtcatacctgcaggtattcattgctcaagagctaagatgtctaaagaggctctggattattgaccgtccttgctggatgatctcttttatgtctgaaatgaagcgtagacgtatatatattaaactagttgaatctacaaggagtgaagatttcagtgggagcaaaatcatttccatttcctttttgtatgcgacaatgccagtttggttgttgttctttgcacttggaatatcatcagataaggaagcctttgatgtgatagatatgcaagattgcgatgcttctgttatcaacacaatatctgcaactatcaaagaatctgatgaattgtgtgaagggtttcgtaaatcagataaagctcgtcaatatgttgatgagttggtaaaaagttcgagatttcctccagcggagtcctttgatgactatattgctaggtttctctttcctgatattagtggaaatagaaacaaagcacttttcttagggtacatggtgaaatgtctgctaatggcttttactgggaagcgtaaatgtgataataaggatgatttcaggaacaagaggctggacctacctggtgaattgcttggaagggaacttagggcacatcttaggctggcagagaagcgcatggttaaggccattcaaagagatttgaatagtgaccgtgagttacaagatcttgaacgctatatagatgcatcgattgttactaatggtctaagtcgtgccttttccactggttcttggtgccatccctacaaaagagctgaacggtgctcaggaattgttgcgactctaaggagaactaatcctcttcaaatgatgtctgacttgaggaaaacccggcagcgggttgcttatgctgggaaagctggtgatgcaagatatccgtaagtaatttatttttcatcaaccaagtattgcatgtccatcttgtgcttttgtatctcctaacattgagtgacttcaaactaaatccctacatacaggaatccatcgtattggggaaagctgtgttttatgtccactccggatggtgaaaactgtggacttgtgaaaaatctagctgttactgctattgttagctcaagggtggtgcagcccttgattgagagcttcatttcttgtggaatgagtaagctgaatgacattcctactgagcacattcaaagaatggataagatctttttgaatggcaattgggtgggatcttgtaaagattcagcttcatttgtatttcgattgaggtgcatgagacgcagcagtctgattgatcctcaggttccctatctttcccatggctggtcactttctgctttaacttatttacaacctttactaagatgcttggtgtgcaggtttacatatatgtgtagtgttttatttttttagaagagtcacaatgtcctgtcattgattttagaaaagtaaaatttcatctttacgcctgcttgaataataatggttttccttggctccttttcaatcttgatgctctgtcttatatctattacctatttttgaggataaatgttttttgcaatttggttaatgagtgagtataaataggttaaaatcatttcctttgaagtgacctatattagtttgtttattatcaatttcccaaattgtgttgtctttcttttctgtttctgttaactactgagcatttcctgcctatctcgactgctgtgtttgtgtcatgtaattttaggtatccttttctcaatgcataaatgtgaggatgttggttgcttttagttgttgacacctttgtcagtactgcatactaatattccacatcaagatgttctttataatgtttcttatgtttctcgtttcatcttattaggttgaaattaaaagggacaagcaccacaaggaggttcgtgtgttttctgatgctggacgaatcctcagaccccttcttgtggttgagaatcttaaaaaaatcagaaaaccaaaggggcgctcattctctttccaggaattaatgcaacaggaaataattgagttcattggtgttgaagaggaggaagatatacaatgtgcgtggggaatcaggcatttgtttgagagtgaaggagcgatatctagttatactcactgtgaactggatccttcctttcttctgggattaagctgcggtatcattccttttgcaaaccataattttgctcggagggtattataccaatctgaaaaacactcacaacaagctattggttactcaacgacaaatccacacatcagagttgatactctttctcatcaactatattatcctcagaggcctcttttcaaaacagttatagccgactgtcttggcagatcagattatactacttttggaagaaaagatgacttcatgagaccagaatacttcaatggacaaaatgcaattgtagcagtcaatgttcatcaggggtttaaccaagaggattccctggttatgaatagggcttctcttgaacgaggtatgtttaggactgaacacctcaggagctataaggcagatgtagaaaacaaggatggaaccaaacgactgaaattgaaggaaaagatagactttggaaaaacagaaagcaaaagaggacgtgttgacaatcttgatgatgatggcttaccttacattggtgcaagtcttcagaccaatgacatcgttattggaaaagtctcagaatctggagaagaccacagtattaagctgaagcatacagaaaagggaatggttcagaaagtattgctttcagcaaatgatgaagggaagaattttgctgtggttactctaagacaggtaaggccttttttggctgcacctcattccacatgtgttgggaacttgggatgaattgatgtggaaaattagttaatttttcaccccaatctatctcaacacatgtggaatgaggtggatacgagtgcatccaaacaagacctaaatgacatttgtcttagcagagaagtattaacaattaaccaattagtacattccttgaattctggcttcacttgcaagcgtacggaccttatttgataatagaatgctgcattcttctcttgactgttccaccgattgacagaaaccatctgtagctgcatttactgtcagttaagcctgttacctgttttgtgtgcctggcattgttatttaacccaatagttaccttgctctcaagcaattattgttggccttcttgatattccttttttaacccaataagattaatgaattatctatgcctatattcttgccatgcaattaagaggagatcatggtctctcatggatgataagaaagacaagcgtagtgtgcgctcatgggttacttcatcctttatggttaaaataaaacttgttttgactttattacccctcttttcttttacaacacttggcactattaacttttaggatgtaacttcgacacatgcaaatatttctaagtacatatattctttgggtaccattgttggcaactctaaaaatggtaatttcacactattgaaccatatatctaaaaaaagtatagataattagaaaatcaaagctagcaagtgttatgaaacaggggtagtacctttttatggggttcagcactttacatgattccattgatccaccccacgtccccataccccaaaaaagtaacaataataatttggcttctccttgttcttgtcttttacgaaacggatgagcccagataggctgcagctcaactcacccttttccatttctttagattagatttcttcaaacacttaatgtgactattctaattttaggttcggacaccttgccttggagataagttttccagcatgcatggccaaaaaggtgttgttggatttctagaatctcaagagaacttcccatttactcacaaaggtatagtcccggatattgtgataaatccgcatgccttcccgacacgtcaaactcctggacagctgcttgaagctgctctggggaagggaatagcctgcaaaggtacaatgagatatgcgacaccattcaccacagcatcagttgatgttattgcagaacagttgcacaggtaagtgtttcttcttccaacggatgaatagctgcttgccttaattcagtaacccgccccttgcacacgaagcaaatatgagaccctttcaaagggttagcctcttttagttgaactttataattgttaagcttattagtacatcttataagaaccttgtacgtccttaatgcaccctatgctctcaagtcttaactctgttggtactttactgcttattacacatacagaagaagaaaaagaaaggtagggaaataaagtacacacagaatggctggtggctaacctcatattttgtatatttgtcatttgagtaaacatgtactgcattgttcctagtatctcttagtttacagtaatttcacatgtatgtatctttttgtaatcttttgctccaaaatggtggaaacacacaactttccttccccttccccttttatcttgtattactatcagttgatgcttatctttttcttaaccgagacatccatagtggcaccactagatataaagctgtgtgcgctcacacactaataacatgttatcagtgaggatcttactccagataatcaagtatctttgcatgtaatgtatctgagaatgagaatattttagttattttcttgtgttttagacttgttttcttctgtgatttgtttagttgatctccaaaattttatgtatcttgttgcattgcagggctggttattcacgatggggaaccgagaatgtactaaatggccgaactggtgaaagaatgcaatccttgattttcatgggccccaccttttatcagaggctgattcatatgtctgaagataaggtgaaattccgtaatactgggccagtgcaccccctcacgaggcagcctgttgccgacaggaaaaggtttggtggagttaagtttggagaaatggagcgtgattgcctcctcgcccatgggtcagctgccaacctgcatgaacgcctcttcatgcttagtgacttctcccagatgcacatctgccagacatgcgagcgtgtggctaatgttgtcatgaggtctgtctccggaggcaaaaagatccgtggcccctactgcggtttctgcaagtcttcggagaacatagtgaggatcaatgtgccctatggcgcaaagctgctctaccaggaactcttcagcatggggatctgcctcaagtttgataccgaagtctgctagaagctgctctacgcctctaccaggaactcttcagcatggggatctgcctcaagtttgataccgaagtctgctagaacttgtagacctgattgtatccagacatccagttatgtacataacgttaccctatgaggatagaggatatcgtactggcagctatgtgaaaattcctgccgatgtgtgctgctggcatagcaaggatgggcgagtgtgatgtagtgaaacggcactggcaggtgggtatctccaagcaggtgtggggatctacctctgctttgagaataaactctgttgaaactagaaaacctgtagcgtttatgctgtt

SEQ ID NO: 806 - DNA, 11133 bp, Sorghum bicolor
ttccgcatcactaccaatacactatgagctctcgtttgattacgagtctaggaagactatgcctagacaggtagattccaagaagttacccgtgacatgtttggattagatcctggtgacttgcgacaatccagttgctcccaggcaatcaaaatctagcgcctggctcagttgcctggcctttttggtttgatttaaaccaataagtaccatctttaaatacagagtatttattattagaaatatttatcctcacaaaaaatattttgataataaatctactaaatgtggaaaacataatgcaactcatttaatttgataataaccatagtaatgttttagagcactagcaaaacaatacactcatccaacttacttggtcagacaataattatcaattttacagacaacttttaggcaacactttttgctagacaaatcgtccagaactccaaccaaacatgctctatattgtacgctatttttcgtctaaattaatagacaaagcgtttgcatctatcgtggtattggtaacaaaagtacacatgcagaagctgaacgcttgccatttggtagtttgattgtttcacccatagacggtggtgacacgttgtgccatagaccactatagaatttagattaacattgaaattatagagtataagtgttctatactataaataaaaattacatttaaaatactattatttagcttattatatttaaatagaccacccttacactaaaccctaattttgccactggtttcaccttttctcgttgccgttggttgggcacactgaacagctaccccgtcctatccgaacctgtgatggatcgcgcacagaagatcacatcacgcgacacgatgttcttgccctccttgatccccgcgaagaggctagttctgccgttcgatgtcccgcatcgcaccatcgacggtcgatctgtctcggcggacaggaaatgctcgtcagaacaagtattacactatatcacagagttaaagacaattaattacatattatttatggtattttgctgatgtgacagcatatttatttaagaaagaggttgaaaaaaataagacttcaaatcttatttaaactacaagtccacattgttcgagataataaataactttagactctatgatagagtctgcattgtgagtgcccttatagcaggctgtaagccagctaaatgctgaggtggaggagagagaagaggagagagtaaaagccggttgtaagcttacaacctcagacacaaaaaccaaaaaaaatctgtaaaacagacaagtggaccatgtattaataatgatgagctaactattatatgatgagtggactgcaaatacttgctctcactgagaccgggacccatagagcactctctgaccactggcccgcctgtcagaagccaccgggcatcgtcgacgccgccggtcgtccccgttaaaccccccgtccccgactcgaggcgattctactttctcccgcaccgcaacaccgccagaaccctccgtccctccctctcccacccactctacgaaggaacaagtgaagcgcgacggcggtcgcgccgcccgccgcctcccaccaccgctggcgccacgctgcctcgccgcaccgccagctgtccgccgaccccgctctccgcgtccgcgtccggcctaccgcagcttccccttcacccaccaggttcggatccaccacccgccgttcgtccgcactttgtaagagtggggaatctgagagcgtaccaaggaagaatgcagtttattttccagaacgaatgcagtttattttccatgatttttagggttcagttgaatccctgtgcctcctatgtcaatttcatcccctggtgtttttgatgactcgtttttcggtagacttgctgtgaaaataaaaccatacagatgggatttctctgttgtgatttgctttatgctgacgttttatctgtggcaatcgtccagtttcttcaattgtccacttgatgatgagccaggctgttgataagtgataggatgatgtttgtatattattgttttctgcttggatttctcttatatgtgctatcacttgctccttggtttttatgcaactcagtgtatactctgggctttataaatgatttaacaccattctaaggttgaggcacacaactctttggaaagatgcttcatgcatgccaattccccttgcgccttatgtccgtatttttcgtagatcattaatgccttagttgttttggtttcatgatcttaacagtccactctgtatggtattatttctgttgagacgattaatttctaattgactgttttgtatttttgtgatacttgataggtataagctgccagtgcttgtgtaatggaagagctacagaaggacagtgggcaaccatcaaatggctctgattctgagccagaagctatggtattggatgacaatggagcaggaaaatcccgtagcatggagggaaacgaggattctcctatagatgccgatgtaggcaaggattctcctatagatgtcaatgaaggccagtcctctatggatgtggatattaaggcaaaatcttctctcaatgatgatgttaatggaaagtcttcttccgagccatattccaatgctccaatcgacatgagtgtggaaagcctagagaaattttgcaaagaagcatcaaggtccttctttgatgaagttggtctgataagccatcagataaattcctacaatgagtttgtctcacatgggctccaggagctttttgattcgctgggggaagtgatcgttgaacctggctatgatccttcaaagaaaggatcaggtggctggaagcatgccatcataaagtttgggagagtgaagcttgaaaagcctgtgttttggaccggcaaagatgaaggttctgttgattttaaaccttggcatgctcgtctccagaatatgacatatgcttcaagacttaaagtagaagtgactattcaggtcctgagtattttcattcttttacatgtccattacttgttctttatatatgccatgattttccataaaaaaatgtgccacctggatgagctataaaatcagtgtcgaggaaaaaaaaagtatagcatcgttctaaatgattgaatagtaaataaagcagcctaggagtggatgggcgattggtgttttgaggacatcccatcagtcgtcagcactatagttattcttgttttctccatttgctcaattccatttaaagggttggttacatttacttattccttatgtatgatgaagctggatacatgtagtgaccttggtacttgttttggtgtcactcacatttgcttagattttatggtcacctgattatctattggttatttttcattgtatcaggtttattctttggagaaaagtgacaaatcgaaaacagggaatgagggttttgttcaaaaaaggaacttcatgaatgaaactcattggatatttattggcctccttccggttatggtgaaatcaaacttatgtttgttgcatagtctcaaggaaagtgagtgcctgtttgatgcaggtggatactttttggtcaagggaatggagaaggtataactctggaatctctgtgttaatgtattatgtaggatgattgaattattaactttcaagtgtccttttgttgctggtatgggactatagggctgtgagctttcttagaacccattcagaaaaattgtgtaatgtgcattactggtatctcataagagggtggaaaatgtccaaatatgattgtagctatgtaaacacaggattctatcgtatctaaggaaactttggcacatcagtcatttgagttggtctcctcctggtgccatgttagcttcttgtgtctaaacctatgcagcatggatacatatatcagtgtcgggcagatatgatatttaattaaataaataataaaaaattaaaattataaaagcaatcgcagccaaaagaaagttcgatattaccctccaatattggtgttttcctattttccaatttttgagtcaaccaaaagtcacgataaacatctccattcactaatttttgaaacaataaagttcataaatcactgtagggaaacatagaagttcaatgtatgagctctgcccttggtcattggtttcattggcatagaagtatagaacgaagcattagcaccagtactactcgaatttgttggtgatgccatttgccatcttgttgcggctgggaaaaatcatggacaaaacacaacagagtgcactagatgaggatggtgaacaaggaaaatcagcagaggtcaagaacttaagaacatgactaattcgagaatagaaagccaacaagagggttgtcgttggctcgtcactgaattgctgctaggggcctgtgcatgctgcgacgtgggggcatggtggagcttcttatcgggggcggcggaggtgcgtcgccagtgtggcggaggctcatcgtcggcagccagtggatgggagcacttgtctttgctgtgtcgatgagctggtgcaccggtgtgcgggtggcgacaccgcgacacgatgcaacgaatgaggcacagaacagcgtgggagtggtgggaatggataaggatggactatgaagtgtcggaggtgtattggtggtctgtcccagatgcgtatcgccggtgcgtaacaacatttgttggatttatttcatttccaatacgctgctgatacgtatcggaggtgtatcctttgcatatcaatatcagatatgtatctgataagggatacactgcccatcacacgtatccatgcaacacaggtctaaactatgcagcacggatacggatacatgtatcggtattggaaggatatggatacggcaattttgtaaaaaaaaaaaatcagtacgcggatacattttactattaaaaaaagataataacacgttaaaactaaaattgataaaacaacaaaacattgcaatctacttaaatacttaagttctattattagttttacagaacagcagttctcaagtctcaaatataggaaagtaataaaaggcattcaggccgagggtgcgggagttccagcgtcagggcaatgggggcttggagatagcattgtttcttgttgggctgggccgtgtccaatgggcacgtactcaaaattcacgaaaataataaaaaaatcggtctaaatgagctgcagtgtgttatttagccatcttggagattctaatagattttcaaagttccagtgataattatttacaggaacgatgcggatctgctgatgacatactcagatactatttcacgatttcagatacctgattatttgctaagttcatttggagtttccttttggggcgtgactatctgagtcatagcctttttactgcaaagagaatgccctttgaatcacatatagtatttttctgtcatctaactatgtttctattgttgttatacctgcaggtattcattgctcaagagcaaagatgtctaaagaggctttgggttagtgatcgtcctttctggatgatctcttttatgcatgaaatcaagcgtagacgtatatatattaaactagttgaatctacaaggagtgaagatttcagtgggagcaaagtcatttccatttcctttttgtatgcgacaatgccagtctggttgttgttctttgcacttggaatatcatcagataaggaagcctttgatgtgatagatatgcaagattgcgatgcttctgttatcaacacgatatctgcaaccatcaaagaatctgatgaactgtgtaaaggctttcgtaaatcagataaagctcgtcaatatgttgatgagttggtaaaaagttcgagatttcctccggcggagtcctttgatgactatgttgctaggtttctctttcctgatattaatggaaataggaacaaagcatttttcttagggtacatggtgaaatgtctgctaatggcttttactgggaagcgtaaatgtgataataaggatgatttcaggaacaagaggctggacctacctggtgaattgcttggaagggaacttagggcgcaacttaggctgttagagaggcgcatggttaaggccattcaaagagatttaaataatgaccgcgagttacaagatcttgaacgttatatagatgcatcgattgttactaatggtctaaatcgtgccttttccactggttcttggtgccatccctacaaaagagctgaacggtgctcaggaattgttgcgactctaagaagaactaatcctcttcaaatgatgtctgacttgaggaaaacccggcagcgggttgcttatgctgggaaagctggtgatgcaagatatccgtaagtatcttatttttcagcaaccaagtattgcatgtccatcttgtgtttttctatctcctaacatggagtgacttaaaactaaacccttacgtacagaaatccatcctattggggaaagctgtgttttctgtccactccggatggtgaaaactgtggacttgtaaaaaatctagctgttactgctattgttagctcaagggtggggcagcccttgattgagagcttcatttcttgtggaatgagtaagctgaatgacattcctacggagcacattcaaagaatggataagatctttttgaatggcaattgggtgggatcttgtaaagattcagcttcatttgtatttcgattgaggtgcatgagacgcagcagtatgattgatcctcaggttctctctctttcccatggctggtcactttctgctttaacttatttgcagcctttactaagatgcttggtgtgcaggttccatacattaaaatgttttgttttagaagagtcctaatttcctgtcattgattttacaaaagtttttcatctttagtatacattgatccatataacttgcttataaagcctgcttgaataataatggttttcctcagttcctttgcaatcttaatgctctgtcttatatctattacctattttttgaggataaatgtttttcacaatttggttaatgattgagtataaataggttaaaatcatttcctttgaagtgaccaagttgttatattagtttgtttattatcaatttcccaagttgtgttctgtgtctttcttttctgtttcagttaaccgctgaacatttcctgcctatctcgactgttgtgtttgagtcatgtagttttaggttgcatccttttctcaatgcactaatgtgaggatgtcggttgtttttagttgttgacacattctcagtactgcatactaatattcaacaccaagatgttctttataatgtttcttgtttcatcttattaggttgaaattaaaagggacaagcaccacaaggaggttcgtgtgttctctgatgcagggagaatcctcagaccccttcttgtggttgagaatcttaataaaatcagaaaaccgaaagggcgttcattctctttccaggaattaatgcaacaagaaataattgagttcattggtgttgaagaggaagaagatatacaatgtgcgtggggaatcaggcatttgtttgagagtgaaggagcgatatctagttatactcactgtgagctggatccttcctttcttatgggattaagctgtggtatcattccttttgcaaaccacaattttgctcggagggtgttgtaccaatctgaaaaacactcgcaacaagctattgggtactcaacgacaaatccacacatcagagttgatactctttctcatcaactttattatcctcagaggcctcttttcaaaacagttatagccgactgtcttggcagatcagattatactgcttttggaagaaaagatgactacacgagaccagaatattttaatggacaaaatgcaatcgtagcagtgaatgttcatcaggggtttaaccaagaggattccctggttatgaatagggcttctcttgaacgaggtatgtttaggactgaacacctcaggagctataagacagatgtagaaaacaaggatggaaccaaacgattgaaattgaaggaaaagatagactttggaaaaacagaaagcaaaagagggcgtgttgacaatcttgatgatgatggcttaccttacattggtgcaagtcttcagaccaatgacatcgtcattggaaaagtctcagaatctggagaagaccacagtattaagctgaagcatacagaaaagggaatggttcagaaagtattgctttcagcaaatgatgaagggaagaattttgctgttgttactttaagacaggtaagccttcttttgctgctcttcattccacacgtgttgggaacttgggatgaattggggtggaaataaggtggatatgagtgcagccaaacaagacctaaatgacatttgtcttagcaaagaagtattaaccattaaccaattagtacgttccttgaattctggcttcactagcgagcgtacggaccttatttgacaatagaatgctgcattcttctcttgactgttccaccgattgacataaaccatctgtagctgcattggctgtcaattaagcatgttgcctgttttgtgtgcctggcatttttatttaacccagtagttaccttgctcttgggtgattattgttggtcttattgacattccttttttaacccaaaaagattaatgaattatctatgcctatattcttgccatgcaattaagaggagatcatggatgataagaaatacaagcatcagtgtgtgctcatggatacttcatccttcatggttaaaataaaacttggttcgactttattacttcttttcttttacaacacttggcactattagcttttaggatgtaacttaaacacacgctaatatttctaagtacatatattctttgtgtaccaatgttggcaattcttacaatggtaattttacactattgagccatatatctaaaaacccattgataattagaaaatcaatgctgacaagttttatgaaacaggggtagtgcctttttatggggttcaccggttcagcactttacatgattgcactgatccaccccatgtcccatactccaaaaaagtaataataagaatttggcttctccttgttcttgacttttaggacatggatgagcccagataggctgctggcttggttgggccagcagctcaactcttttccatttccttagattccttccaacacttataacgtgactattctgattttctttgcttccccatccccaccttcacatttataccacatgttactttttattgaccatatgaagctttctttgttgatttgattttaggttcggacaccttgccttggagataagttttccagcatgcatggccaaaaaggtgttgttggttttctagaatctcaagagaacttcccatttactcacgaaggtatagtcccagatattgtgataaatccacatgccttcccaacacgtcaaactcccggacaactgcttgaagctgctctggggaagggaatagcctgcaaaggtacaatgagatatgcaacaccattcaccacagcatctgttgacgttattgcagagcagttgcacaagtaagtgtttcttcttgtaacggatgaatagctgcttgccttaattcagaccctttcaaagggttgagcattttctagcctcttttagttgaactttgtaatcgttaagcttactagtacatcttataacaaccttgtacgtcattaatgcaccctatgctctcaagtcttaactctgttagtacttcactgcttattacacatacagaagaagaaaaggaaaaataaatgtagggaaataaaatgcacatgcacagaatggctggtggctaacctcgcattttgtatattggtcacttgagtaaacatgtattgcattgttcttagtatcccttaggttacagtaatttcacatgtatgtattttttttgtaatcttttgctccaaaatggtggaagcacacaatttcctttccctttcccttttaacttgtattactatcagttgatgcttatctttttcttaactgagacatccatagtggcacctcaagtagaagatataaagctgagtgtgctcacacactaacatgttatcagtgaggatcttacttcagataatcaagtaactttgcatggaatgtatctgagaatgaaaatattttagttattttcttgcgttgtagacttgttttcttctgtgacttgtttagttgatttccaaaattttatgtatcttgttgcatcgcagggctggttattcacggtggggagctgagaatgttctaaatggccgaactggtgaaagaatgcaatccttggttttcatgggtcctaccttttaccagaggctgattcatatgtccgaagataaggtgaaattccgtaacactgggccggtgcaccccctcacgaggcagcctgttgctgacaggaaaaggtttggcggagttaagtttggagaaatggagcgtgattgcctcctcgcccacgggtcagctgccaacctgcatgagcgcctcttcatgcttagtgacttctcccagatgcacatctgccagacatgcgagcgtgtggccaatgttgtcatgaggtctgttcctggaggcaaaaagatccgtggcccctactgcggcttctgcaagtcttcggagaacatagtgaggatcaatgtgccctatggcgcgaagctgctctaccaggaactcttcagcatggggatctgcctcaagtttgacaccgaagtctgctaggaacttgtagacctgcttgtatccagacatccagttatgtacataaagttagcctatgaggatatcgtactgggctactggcagctatgtgaaaactcgtgccgatgtgtgatgctggcatagcaaaggatgggcgagtctgatggagtgcaacggcactggcaggtgggtttctccaacccgatgtggggatctaccactgctctgctttgaggataaactctgttgaaactagaaaccttgtagcgtttatgtgctgtttcgccctgctcgtctgataaactatgctcaagtgaatgaacacttgtttcctgtttcttgcttg

SEQ ID NO: 807 - DNA, 8584 bp, Sorghum bicolor
atggctgtttaagtgaccatttagaccgacacctcacgataatactgagtttgttcacttgtttgaaaatctatagttaaaattattattcgccaatttattatgaaagaaaaatactgctaaccgagcgggaccactacccctaatccccatcgccaagcctttggtaagcggcccctaatccctaatggctccgtcggatgcaaatcagaggtgcccagagcagtgaaggagacactgaccggtgggacccagctaaagcgaacggcctgccaaaacaggggctcacgagaaaacagagagccgccgtgctgatcctacagtaccataaagcacactcctctcctcggtcgcaagaaacgcagcgccgcggaaaaccccaaccggcgccgtcgcctgcgcccgcgcccgcgcccggcgcgccgtagggtttcccctcgcctcgccgccggcgatcgccggtgcgcaaggtacgcctctccgccctccgcccaattccgggcctcgttgccaccgccatctcgcgcccgccccgttccgcgagcgcaatgcggcgtttcctctgctcctggactgcaggactggctcgctagctcgcggcctggactgctgcacgcgtctctctcttttttttttcgtttctttgtttcgttcggcggcgagggctttgctttggagcccgtgccccctcgccgccggcagcgcgtggttttggcgcttcgagcattgacgtggccccgcctcatgtgggcaccccgcccatgttcttgttatctgtgtgcgtctcatgaccgggctggggttttgtgctgctagtgcggtgctgaattgtggggggttttctggtgttggtgggtgccccgtgatcgttgatcgggacccgtggtggtggcgagccagccctcttctgatttctaaatcccaagacaagatgcaaggttgcgcgaacttgccatacgtgatggtgtgctgggcctgcctgaccaaatcgccattagaaaaggaccagagagggagacagtgggagtgaaatggtggattttgttgaaaatcttcttgttttttttaaaaaaaaattgggcgtgattggtactgttatgcctgtaaggtgctccatttaggtagaattctgtgaaatggatggatgtctgatgtgtcaattttttataaaggcggcatcgttgcgcgtgcatctgcctgataaattatctgattgctttcctttttgtggaatgctacgtggagccctgggtgcacatcttgtactgattttatcttttggttaagaaattgaaaagttgcgctgttgcacaaattgtgtgtgatttcagtgtttgttgctgaatgccttgtggatgctcatgttctgctttctgatcttctgatttcaaagttgtgcatttctatgatgactgtgctcattatgttgtttcccttttctattgtataaaggcagggattttgttgacaccgagtgccagctgcctgttgtttagcaacgcgggaaccacaaatggatggtgatcagtcaactgttgtcttagatactgatatgatggattgcctgaatttcgatggctatggagatgttgaagatccccgcaaggagggtgcaaaaggggagcggcagccttctggcaaagttgatgaactgcagtctactatggatgtcgatttgacatgcatagcttatgtggaagatgaagggaatgaaaaacagaatgctatggatgtggatttgaaagaaatactgcctgaggaagatgaagggaaaggaaaggcttcttcagacataccctcacatgtaccagttgattttgatgttgcaagcctcgagaagttttgcagagaagcatcaagatcatttttcagtgcaactggactagttagccatcagattaactcatacaatcaatttgtctcccatggactccaagacctctttgattctcttggggaaatcactgtggagcctgattatgacccttcaaataaaagtggtgcttggaaacatgccactataaaatttggtagggttgagcttagtgagccagtgtttatggttgacaaccttgaccttgaacagcaagatctcaaatttaagccaagacatgcccgcctccagcggatgacatatgcgtctaggatgaatgtagaaatgactgctcaggtcaggatgctcctaattcatgttacatatcaagtaaacaataggggtaaaatatactgtacctgctaagaaagaactaaaaatgttgttttcttattctcataactagtatggatgttgcggtcaaaaaataactagtatggatgttaaatgtgaccaatcagtcttttcttatatttcacaaatgacatggaagctagtgagattaagcacttctccagttcatttataactttgcttttgatggcacaatagccataatgatgtcccttatatttcccccattactcagcctgcaaaactcatgtagactttgaatgtagctattgcactgtgccttggcattctgcttgtagtattgccttctccctgtttattaagcagcagatgtgatttaaatttactctgccatctgtaatcaagttatgaccttgatatgtgtatcaataagatttctactgatattttaccttctgatcaattactgttttgactttatcaggtttatatactcgacaaaagtgacaaagccaagactggtaaggatacacatgttcatagaagagagataatgacagaaactaaacaagtcagcatgggattgttacctgtgatggtgaagtcaaatttgtgctggctgcataaacttcaagaaagtgattgccagtttgattttggtggctactttttgatcaaaggaacagagaaggtactgcctgacatgatccatgctgctcattcaattctcagaaaatgtatttcacaaagatccattgcactatgcattcttatagattttgatggtactatatattatgtatcaaatgttagtcagaacaaacgaggttttattgtttttttagggtgaggtttcatggttcacaatatatgtgacgactctatatggcactgctatgcaattgccctacatgcttactatcttgcccacctttcttaatagtttaagctttggcctttggtgaactaattagtgcatgaaactcaatatgttgtcagaaacaaaggttttgagttgagacctggctatcccaagtttcataaagggtgactgcagctcacttctagtgcacaccttagtcttgagggtacctagccatgagggaagtattgctgtgttacttgccttgccgaatacttaagagagagagagagagagagagagagagagagagagagagagagatgagggagactatcctggcactgccatacatatgttttgtgaaatttcaggctaactcaaatggagtttacaaaatttagcttggaaagtgctgtgataagtattatatgcatgtggccaaagttcaaatcaaatatttatatagtaagacggcggtgcttcatatttatgcatggaaaatgttctgtaacgttgtcaagaaattttgcagttaacaaattacaattgaagttaagaaagtactccctccgtataggattcagaagtcgttttggacaaggtttgggtcaaacattgggaatataaatcattactaacttttaaattgttgagtttgcaaatgtgaaaattatataaatagatttgtcttgaaaaatactttcataaaagtatacatatattattttgtcctaaatatttttataaaaataagaggtcaaagttgtgttttggagaccgtgtcgctgtcctaaacgacttctaaatcctatacggatggagtattagccgtttgatattgaatatgtttgacaccatgtctgggtgaagcacatctcattatgattgctttaaattctgcaggtattcattgctgaagagcaaagatttttatcaaggatttggatcacagactaccccagttgggatgcaagttacctgtctcaaatcaaaagagaaaagatcaatataaaacttgttccgtccaaacgcaatgaaagctgcaaagtcataaccatttacttcatgggtacgattataccaatttgggtagtattttttgcacttggtgtatcgtcagacaaggaagcttttgatatgattgatatcctagactgtgatgcttccatagtcaacataatatcatcaactattaaagaatctcatgaagaatttgaaggcttccgcgctccaggtagagcctgtcaatatgttgataagctgatcagaaaatcaaagtttccgcccaaagaatcctttgatgagtatgtttgtaggtatatgtttcctagtgtcaatggggttaggagcaaggcacttttcttgggttacatggtaaaatgtctgctaatggcatactctggcaatcgaaaatgtgataataaggatgatttccgtaacaagaggctaggtctcgcctgccaattgcttcggagagaactctggactcatattaagagagcagaatggcgcatggttaagctcatgcagagagatttgagcaatgatggcaacttgcaagaccttaggcgttatgtggatgcgtcaattattaccaatggattgaatcgggctttctccactggttcttggcggcatccttatctaaaagcaaggtgttcaggggttgtagcaacccttcggagaacaaatccacttcaaatgatgtctgatctgaggaagacgcgacagtgggttgcgtattctggagcggttggagatgcaagatacccgtaagttccctgttcctttgtacaaaaaaatgatgcatgcctactctcttccttttccaatatccatgtgcagactgactttcttaatgaaacacgggccacaggtctcgttcgcgaaaaaaatgtgcaaactgactttccttttgcaggaatccatccttctggggaaaattgtgttttttgtccactccggatggtgaaaaatgtggatttgtgaaaaaccttgctgttactgctgtggttagctctgtagtgaggaaaccattgattgatacatttgtttcttgtggaatgaagaaactggacgatatttcactacaagatatttctgggaaagacaggatcttcttgaatggaagcttgcttggagtatgtgcagacccacatgaattgactttgcgtttaagaagtttgaggcgtagcaagctaattgatcctcaggtctgctcagtttccatatctgtcaaactaacgctcaattgtcttgaacctcagttttcagatccaggatagtgtcttactcccgttcgtggtctttgaaaactctcctaaaccattattcatactttcaaatttttttggggatatattttaccttgcaccgtcatgagtcctgttaccttcatgatatcgtgatagatttcgctgcttagtaagttattgactactgaaagttgtttcttcagtatagctgtgctggtgtatctagtggtttaaaaattttcagagcaattatcaaccaacctttaatatcgtactcactttagttatcttgtgatgagtcgatactcgataccattctaatattctcttgctcattactagttttcctttgattctttcaaaaaaaaaagttttctttacgtaatctcaaaaggagatctgaaatttcatgctaatggaattctgaactgaacttgctttattaccttatgcatttggtgtatgtttatgaatattcagtattatattttctgccaaaaggtggaatatggttgttttgttacatgtactatttctgcttcactggaatacctcaaagtacatatgttgcaacaagctggtagtaatacagttacttttcctattctgaacttgaataggttgaaatcaaaagggacaagcaccataaagaagttcgtgtactttgtgatccaggcagaattctaagaccacttcttgtagttgaaaatctaagaagaatcacaagaccaaaagatggactatactcttttcaggaacttatagatcaaaacatagttgaactgattggtgttgaagaagaggaggatatccaatgtgcgtctggaattagacatctattctcaggggagaaagaagacaggtcttctggctatactcattgtgaacttgatccttctttcttgctagggttgagttgcagtctcattccctttgccaaccatgataatggtaagagggttctgatgcaagctgaaaaaatatcacagcaggctattggctactcccctacaaattctcacactaggctcgacaccctttcacatcaaatcttctatccacaaagacccttgtttaaaactgtggtgtcctatggtcttggaaaggcagagacagcctacagctttggacgaaaagatgactttaatacaccagaatatttcaatggccaaaatgcaatagtctcaatcaatgttcatcagggattcaaccaagaagattctctggtcctgaatagggcctctttagagcgtggcatgtttcgtacactacatttaaagagctataaagcacaagtcgaaaacaaagagatcacaaggcgtctcaaacacagggaaagtatcaattttggtaaagtgcaaagcaagagggggaaggttgacagtctggacagtgagggtttaccatatgttggagcaagtcttcaaagtggtgacattgtcattggaaaggtctcagagtctggtgaagatcatagtgccaaactgatgcatactgagaaagggatggtggataaggtagttctttcagcgaatgatgatggggtgaactttgcaactgttactctaagacaggtgagtaataaatctttgcaagattattctgcactgtttttcgtggcccatgtttgcatgcagtggcattttccttacatagtacagtagagcatggcattatccttacatagtacagagagaatggcattattctctgctatttggctgatttgctttcctgtcttaaggaataactcagaaaggttctatgtttttctcatcttgtgcatgtctgttctccttatgatttaggaaatgatagatggcattctccttgcatttttgtcttgattatttagtgctctgaatctctgatatcacctcaggtgtcaatgatatataaaacatttagtttgtaatttgcaccatttcataacaatgcttatgctcttacttgtcttgcttgctacaagttatgtatgcccacttgtcagtctccctagtgattaacctaataatcgtttcagtctcgctcgccatgcgttggagacaagtttgccagcatgcatggacaaaaaggagtggttggcctattggattcccaggagaatttcccatttacttgccaagggatagttccagacatcgtcataaacccacatggttttccaactcgtcaaactcctggtcagttgcttgaagctgctctggggaaggggattgccatgggtgggaaggtcaggtatgcaacaccgttcaccactccaaccgtggacgtgatcaccgaacagctgcacaagtaagttctatttacatgacggattcctttctcacatttgtactttaattcgcccttgcacacatctggggaaaactatagacaggatactggtaactgaattgcagcacatggcatctcatgtcaaggttctttgttatggctttagcaagtgctcagcttgccctctcattgcaagttttacaggaacatgcaatgcattttcatggtgtatttatcaatgaaaatgcactaattattaaatatgcatatatgtgaggctggtcagccattcttatggcacatagctgttctctcatgtttctgtaccttgtggatttgctttgcagggctgggttttcaaggtggggcgaggagagcgtcctgaacgggcagaccggcgagaggatgaagtccctggtgttcatgggaccgaccttctaccagcggctggtgcacatggccgaggacaaggtgaagttccggaacacggggccagtgcacccggtgacgcggcagccggtggaggacaagaagcggttcggcggcgtcaagttcggggagatggagcgcgactgcatgctcgcccacggcgccgccgccaacctccacgagcggctcttcacgctcagcgacttctcgcagatgcacatctgccaggcctgccagcgggtggccaacgtgatcatgaggcccgccgagggcggcagcaagaaggtgcacggcccctactgcatgttctgccgctccgcggagcgcatcgtccgcgtcaacgtgccctacggctccaagctgctgtaccaggagctcttctgcatgggcatctgcctcaagtttgacaccgagatccgctagaacaacgccatgccatttcatcagcccgtctctttttgaagccgtagactacatgcatttgcaattgcaacttggttgcctaggatattggtgattgaagtcgaccgtagactacatacatttttgtaactttgttgcctaggaaga

SEQ ID NO: 808 - DNA, 7174 bp, Sorghum bicolor
caaaaaaatttcgcatctaaacaaggcccgggcggtttttgggcaaggtgcgagactagctcttgttttcactcaaaaactaaaaacttttcaagatttcatgtcacatcaaatcttgcggcatatggagtattaaatatagacaaaaatagaaaactaattacacagtttatccgtaaatcatgagacgaatcttttaaaccttgttactccatgattggataatatttgtcaaataaaaacaaaaatactacagtgtcaaaattcaaaaacttttcgtatctaaacaaggcctaggccgtgtttagttcatgaaccaaaaaatttcggaacaccgtaacacttttgtttgttttttataattattgtccaaccatggactaactaggctcaaaagattcatctcataaattttgacctaattgtgcaattagtttttatttttatctatatttaatactttatgtatgcgtctaaagatttgatatgatgagaaatattaaatttttttggagttttaggtggaagtaaacaaagcccacgtgcagaagcgctagcgagttctctttccagctctcactcttcttcacgttgaattctcaacacaggccttatttagtttaaattttttttagttttcgctactatagcattttcgtttgtatttgacaaacattatctaattatggactaactaggctcaaaagattcgtctcctaaattacaggcaaactgtgtaattagtttttgttttcgtttatatttaatgcttcatgtatgtgtgcaaacattcgatgtgacagagaattttgaaaatttttaggtttttggtggaactaaacaagggcacggtactcaaatagctagcacaatcgtcttgttgggacgtcgatagtatccaacaaattaggtattgtttagagcaactccaagatactctctaaatcattctctaaatatgaagaatagagattttagtgaaaaactattctccaacagtttgtctaaatgattatgcaaatatagtcatcttctattccgtatttttcgctagctataaataaaagacgagaatgactctctagagtgcgccatgagagataaaaaagctattggacagtgaagaatatagaaaacgatttttataaaaatgattctctaaatgatgatttagagagcgagatttgctaagactcttgaagatgctcttaaatactaaaagtttttaaagttatacactgcaacatttttatgtctatatttaatgttttatgtatgcgttcaaagattcaatgggacgaagaattgtgtaatcttttaaaattttaaaggcatctaaataaggcactagcggagtcggttgagcaatgaaattctgaattcctataaagaaaaaaaaacgaaaaagaaagaagaaaccctcttttgggggcacaaaacccccggccgtgacagcctgacagggatcccggtcctccagctccacgcccgcccgccactatgtcgatggcggctcccgcgccgggcgccacggccacggtgcgggtagccaacatcccggcctcggccatcgccgccgagctgctcgccttctttgactccgccgtcaccaccaccggcgcggccttcgcttgcgagatcgccgccgcccaccgcggctggctcagccgcggccacggctccgtccagtttgactcctccgccgccgccatccatgccatcgacctcgcctcctcgggccgcctgccccctttcctcggctcctgcctctccgtctcccccgcccacgccgacctcctgccccgcgcgcctgacctctccctccgcgccgccgacgcgggcctcattctaggcaaccgcgtcgccgagcgagagctggaggcggcctactcctgggacggcgtgcgggccgaggtcatcccgaggaagcggcgtgtggacctctacctgaagcaggattcccggagctacaagcttgaggttctctttgaggacatcagggagtgctttgggtgccaccttgatgggacgggcgccatcttgctgcaggtgagcagcttagaccgtgctattcgcttcgatgcacaaagttccaaaaccttgatgcgcccttatatgaattaaagtgtgcctgtttcgaattaatagttgacacgcagatatctgattgatatacactgtcatcactcatcaaccctcattttcggtcagtagccagggcccaagagattcacccagtgattgtgatagagtagcttattatgggtagagttgcaagtcaacaagtaaatctacagatactttcagaccaaaggcaattggcccagctttattgaaagcctaagaggagttttactggtgttaccaattaccagtttattacaaaagacaagcctttgataactctactcgactttgacttctctctggacggaacacctctgaacaaaccttcttaagcaactatcagtgaaagaacctcaactactgtcctcagaactcaggaaatgaaaagaactacaccaaatgtccagcaaaaggcagccttgcagaagagttcttttgacagttgagcgatcatctccacatcaacatataattgaatttctattctggcctaacagcccagcagaatgggagcatacccaagtgcgttgcagcctgcagatagagctttcttcttcctctagtgctgcacagaaggatatttttgcattcttctatggcctgctagagtcctctatgtctgctatcgcatatgttgtgtagcagcattcaaatcaatcacactataggttttcatatgattcatttactgcataatctagccattttccattttgagtaattactcaacgacttgagatatgcacaataaatgtaatcctcataagggataagaataagatcttttactttgaagtttgaaactgatcaattttttttccacctgagaaattcccatttccattaaaatattaaaggaaataaatagtttgtgagataaaagacagaaataaggaaagaagaagagtttaaaggccttagagcctgcagccaaagctacaaaaactaaagccaaaagctctgactaagagcaccgactacagagatttaacctaccaaccttctccatctctcagaaagtttcagcagaaaggacataacaggagtatcagcagcaggatagaaatatatcaattacagaaaccaaaaaagacggtttctccttcagtgtgatagccttttgagattcacagcctgtccttaagccggagcattgccttgcccatcagggtctccatgaaactgatcaattaacttcatatttatgcaagcatactcgagtttcctctgcatgttatttgaagcatgtctttttcatcatatattgagagtgtaagctgtttaagatttattaacttaatacattgaggtagattttacaaatgctattctatcaattctcctgttaatattaagctgccctgttgaatacatagttatagctgcaatgatatagatttaatgcttgtcatatttcttcgactatcaatttgtttcagctgcaatgttcttagggcatcttttttaatgaatctgaagctactcttctgataaaattaatattatccttgcttcagctgacttatgcaccaagaatatacactgcaatttctgggtcaacagttaaatcgaggtttacagatgaccgctttcatgcatgcaaggaggatgccaaatttgcatgggtcagagcactagattttacacctaataactctttcggcgagtgttccactcttgtcctgaaactgagcaaaggtgtaccagtatcagatattcttgaaagtttacccttctcaggagaattagaggaattggccatttcttcgatgcttgcatttggctcctcctccaatgtggttcctcttgttgactgcccgaatggcttttccgtgccttatgaagttcttttccgtctgaactctcttgttcacatggggaagctagttgccaggcatgttaatgctgatctgtttaaagtccttgaagagctgtcaattgatactttaaggagaatatttgagaaaatgagcaaattaaaatctacctgctatgaacctttgcaattcatcagacatgaggctcatagcatgagtaagagcaagaaagcctttttgtccaacaagaaggacggtggaaaattgatgaggtgttacagaattcacatcacaccatcaaaaatatactgcttgggacctgaggaagaagtttcaaattacgtggttaagtaccactctgagtatgcttctgactttgctcgagttacttttgttgatgaagactggagcaagctttctcccaatgcattatcagctagaactgaacaaggtttcttttctacacctttgaaaactggcctgtatcatcgtattctctccattctaaaggaaggattttgcattggcccaaaaaaatatgaatttttggccttttcagcaagtcaacttcgtggtaattctgtttggatgtttgcttcaaataattctttgactgctgagagtataaggaggtggatgggccacttcgaagatatccgttcagtctccaagtgtgcagctagaatgggccaactgtttagctcctccaggcaaacatttgaaatctcatcatatgatgtagaagtaattccagatattgaagtcacaagtgatggcactaaatatatattttcagatggtatcgggaagatttctactagatttgccagacagattgccaagttatttggattagaccctgctcaccctccttctgcttttcaaataaggtatgggggctataaaggagtcatcactattgaccctacttcctttttcaacctttctctacgacctagtatgaagaagtttgagtcgaagagcactatgctgaacattacaaattggagcaagtctcagccatgttacgtgaaccgtgaaattatttctcttctttcgacattggggataaaggatgaagtatttgaatcgatgcaacaagatgacatgcacgaatcagacggaatgctaacaaataaagaagccgctttgtctgtcctagggaaaattggtggtgctgataccaagacagcttctgagatggtgctgcaaggctatgaaccaagttcagagccttacctgttaatgattcttaaagcccatcgggctaataggctgaccgacataagaactaggtgtaagattcatgtccagaaaggccgtgttcttattggttgtttggatgaaacctgcacattagactatggccaagtttacatcagaattacaaagaatcgcaaggagcagaagtacagtgaacagccattcttttgcaatgatgatggcaaaacagctgtaattgttggaaaagttgcagtcacaaaaaacccatgtctccatcctggtgatgtcagagtacttgaagctgtatatgaccctgcattggatgctaggggtcttattgattgtgttgtatttcctcagagaggggaaaggtatgtttgctattctgaatctgaaaaatgacttatctttagaatgtggagttcaatttctctgtccatggctgtgaagcagcctgtctactgaactaagacactgtatctgtctctgctagcaatgttatccatgttatgttgatcttgtagtttacaactaaccatttggattaatgttgtcaatgcttgctctatccttgaaatcttcaaattaattaggcctcatccaaatgaatgctcgggtggcgatttggatggcgacctcttctttattacttgggatgacaaactgattccggagaaggttgatgcacctatggactacactgcaacgaggccacgcataatggaccatgctgttacactcgaggtacactccatactcgtgagtgtctttcattcgctcatttttctggattatatatgtatatactatggttgatttgctgttgttcttattcggttaataggatttctatagtctcaacatatcagtttataagcgatctttcccctgagactattgattcaggcattttaatgataatgattttggagctaaggatccttgcatgtttctaaaatgtgtgtatgcatttaggattaacttcatgaaacaggtgctgatagggcaataatgagcatatagaactcgctgttaagaccacattttagtccagtcagcatggtattaagatggtatgtgaattatgctcgccgtgaacattcagcaaatgcctgcatatttcgccatcttgcgtggttattctcgcttgagcaaaatgttacaaatgaacatctgcatgcaaatgcttgcaggaaattcagaagcacttcgtcaattacatgataaatgacgccctcggtgttatctccaccgcccacttgatccacgcagaccgtaatccgctgaaagctcgcagccccgagtgcctccagctggccgctctgcactccatggcggtcgactttgccaagacgggagctccagccgagatgcccgtggcgctgaggccccgggagttcccggacttcatggaacggtgggagaggccaatgtacgtctccaccagcgtcctcggcaagctctaccgcgcagccctgcgccatgaggagaacgcagaagcgctcctgcctgcgggcccaccgcgctgcgtgtacgacccggacctcgaggtcgctggtttcgacaagttcctggacaccgcggaggagcagtacgaggtgtacgccgagaagctgggcaccctgatgacatactactccgcggagcacgaggacgagatcctgacgggcaacatccggaacaagctggtgtatctgcggcgggacaacaagcgctacttcgagatgaaggaccggatcatcgccgccgtcgacgccctgcacgctgaggtgagggggtggctcagggctcgcaaggaggatgacgcgtccaagttggcgtcggcgtggtaccacgtgacgtaccacccggaccgccgcggcgagaagcggttctggagcttcccgtgggtcgcctgcgacaccctgctggcgatcaaggcggcgcgtaggtgccggaagcgggtggaagacgccgctgcgcccatggactgcgacgcctcctagacggaggtgccactgtcaaag

SEQ ID NO: 809 - DNA, 8168 bp, Sorghum bicolor
ctatgcatcaaagaattcttagtgcgatgtgatacgaagctcttgtttgcattgtagtctttggaaatatcttccaaaagtttgatcggttctattcactagatctttcctagtattcaaccaatctaacataattaatccatcctccttattaaactttttttgctttttcgttttgggcctggcaccataagtacttgcagcaacaatagaagagagcacatcaaattggctgaacaatccatccaaatacagatcatcattgttgctattcgccatatccatccaaatacagatcaccattgtcgctattcgccgtatcaatctaggaacttggattatccatgatctatatttacattcaacaaacaataagttacaaatacgccatatcacgacacgtatgaatgtgttgttcatcaaaaaaagaagagaaatttcatctgctttcggccgattgcctatgacaaagctatcatacaagaggcaacaacactattgaggcgatgtggaaccaactagtgcccagtagggcaagggagctccaagcgactggctgaacatagctatagattcaatggcggcgtgcagatgtgttgttgctctgttatacaagacagaagtgaggtgaaggtgagtccgtaccaatggtgccagactaaaagaggggaggagtgggggtggggggagaacagatgcccgctaaaaccaacaatatatctcgtgcaaaaaagaaagttgctcacgcgagaagtaacacagaaacaaagccagagaggcggaatactaagttctcagtttcaaaaactgatcgctcgcacgagatgtattgcgaaaaccagcccacaaaggagggatataaagttctctcgactatagaaacatatgagttggagatattattttacaaatttttatttttaataagcttttttatcaaactatcaaagagaactttttttggctaaaaaatcaagatagataattgttttataaaactcctagagatgcttaagaaaaaaacgagatagctatttcagaatttgggcctgtcttttaatttgcctgctctgatatcacaaatggtgctataggcatcaatacaatcaaacttctccttttgctggtacataccttttcttcaggacattaagtatgctgatatagatattaaatatattgatatcacactgttttttaaaaacactgtagttgtattaaaaattgagacatgaaactccacaccgacctcagtggaaaacgataaatggctgaagaaaaagagaggccattgaccgaccaaccacaacaacacacactttgcattgcacccatccgttcctcgttacgcttaaaaatttaaaaccccttcagattccattaattaaaccaaatcatcaaccccctcaaaaaccccgtcgggtcggcccctcccaaaaagaccaatcgctctctcctccggcatccaccacccaacggagccgcggcaaccgccacaccatgggatcgctgcggggcgcggcagccccgtccccggcgccgcgcgcgggcgacctggtgaccacgcaggttagcctgggcggatttgacgccaccgtcaaggcgctcgatcttgccgactttctcgagttgaaggcgggcttggtctggcgctgccgcgtcaagacctcctggaccccgccggacgcctatcccgacttccttctccccaccgtcacctccgccgccgcgcagccgccacagtacgatcgcgtgcctccgcacgccttcgtccactttgcgcgcccggagggcgcgcgcgccgccgccgacgcagcggggcggtccgagctcatcctctccgggaaacccctgcgcgccgcctccgcgcaggagagctcccttcgggcctcccgccgccgcagtgtctcgccattccgcttccctggctcacgcctcgaggtcggggatctcccggccaaggacgccttcctcgccgcctggcgcggtccggcctctgggctcgagttctccgtcgatccgttcgacgggtcttgccgcctcatcttcgcccgcgacaccgcattcaaagtccgggagttccgcgagtctgtggtcatgcgctgcgacgtcaagctcgagttccccgtacgcgacgtcgccgaagtcagggtgttccggctcgactgctcgctgctgatccggctgtcggcggcaccgctggtttattaccgcacggcggacgacgacatccacgagtccgtgccgttcgacctgctcgacgacgatgacccgtggatacggaccacggacatcacccccagtggcgcgattgggcggtgcggcgcgtatagaatcacattctcgccgcgcttctggccaaagatggaacgcgcgctggcgtacatgagggataggagggtgccgatcgttgattgcggtggtggttggggggccaggaggggcctcaccgtgcgagatgagcctgagtttggggagcgaatgcaggacctgttcttctgcgtgcagcactccgagggtctcaagtttccggtgttgttcctcgtgaatgctctggtgcacaagggagtaataaatcaacaccacctcacgcctgaattcttcggcttgctccagaggaaggaggatgatgtgaatgtggctgctttgagggaattttggggggacaaatttccagtttttgatgcatgtggcaggctgaagaatctgcaagatagggttgccaggtaccccaaacttcttcgcaacaagattggggatgacaattcagaggtgaggaggctggtagtcacgcccaccaaagcttattgcctgccaccagaagtggagcgctctaatcgtgtcatccgtcattatcgtgaagtcacagacagatttctcagggttacttttatggatgagggtatgcagctactgaacagtaatgtgctgaatttctctgctgcgcaaattgtcaaagatttgatgtcaaactcgttcctgcataagacaacagtgtacaagcgtattaaaacatttttgacagagggattccacatgtgtggtaggaagtactcatttcttgcattctcatcgaaccagctgagggacaggtcagcttggttcttcgcagaggacagaatgagaacagtggaaaccattaggaaatggatggggcggttcacaagtaagaatgtagcaaagcacgctgctcggatggggcagtgcttctcatctacatatgctacagtggtgatgcagccgcatgaggtcaatgagtgtctcgaggaagttgaacgcaatgggtacattttctctgatggaattggcaagattacgtgtgaccttgcacttgaagttgctcagaagctgcgattgacagataatcccccatccgcttaccagattaggtatgcaggcttcaagggtgttatagctgtctgggaaggagaaaatgatgggatacgactttccctgaggccgagcatgcacaagtttgagtctaaccataatgtgttagaggtggtctcatggacaaagtttcagccaggattcttaaaccgtcagattattacattactgtcctccttgaatgtcccggatgctatcttttctcaaatgcaggaagccatgttgtctaatctcaataatattttgtcggacactgatgttgcttttgacattgtaaccacctcttgtgctgagcaaggaaacactgcagcactgatgttgagtgctggcatttcacctggaactgagccacacctgaaagcaatgctgttagctataaggtcctcacagctactgggtcttttggagaagacaaggatttttgtgccgaaggggaggtggttgatgggctgccttgatgaacttgggatccttgagcaaggacagtgctttatccgggcgtcatctccatcactcaataattgtctggtaaagcatggaccaagattttcctcagcaaacaaaaatgcagagaccattgtgggtactatcgtaatggcaaagaatccatgccttcatccaggggatgtccggatccttgaagctgttgatgtgcctgaactgcatcaccttgttgattgcttggtcttccccaagaaaggtgagaggccacatgccaatgaagcatctgggagtgatcttgatggggatctctactttgtgacatgggatgaaaaccttataccacctggcaaaaagagttggaaccctatggactactccccaactgaagcaaaacaactaccgcgcgcagtatccccacatgtaagctcaactttttggcatttaggcatttgttcccttaaaagttcaatatatggatgcattgcttcaaatattagctcattttgataccctcccattactaatttcttcttgacatgttagtgttcttactgagcaatctctgttgcagctaatatttaagttgagcataaacttccatggaaattgtattgtaggattgactctgaatcagggattctttttcttcctattgattccatgcctgttaatatttcctagagttttgaactatgtgtctatgattatttgtcttctactccctccagtccggtttctaaagtgtccttgtgttttagagaaagtccgtaatattattaggcgtcactcgaatactgagacaggatttaactcatagacagaactgaatagtcacttgcatggagatttttccctttttcttctggcatgattaactgaatctccaataaaaaatcggtagctagcacttgactaataccaggcaattgatgtgctgcaatcgcatgcatgccgcaaaaaacgatccaataaacagagcgattaatatgatgtcacaaacaccccattgctccttggtatttgaggtttcatcttatgcaccttagaaaccagactggagtgagtatttgaataacagatgatagctctgatgacatttctttagtaacaaccctgaaagttaccatctcttcttatgtatcaactttcatggacttactatctcttatactgacaatggatcgttgtacgataattttatgatggtatgtatttattctagtatcttaatatgaatcatgcaaaatcccatataatataattttactataacaattcttggaattaatgtgctctgcacagaatacatgtataatttgcagaaactgtgttcatgtcatttgctcaattaatacatgtttctaaattttcatttgacaatctacatccacaacgcaacggcattattggtcaaagttaaaagagttttagttgcaaaatcacttgtttctgacttcatttctatcccacatccttttctttgacaccaattggtagtagcgggtcactttgttacttcatttctatcccacatccttttctttgagatcttaattagttcaattaaattaactttgggttgacccagagaaaataaaactttgcatctctagtgttttgtgtgtattaggtataggtataggttaaaggcttgatcattctgaaggtagtaagctaatgtgcacagctggatttcaataacatgttggcagaactctaaaggcttgatcattctaattagttttcatttaattcttggagaactgtacctatagagtagtagagtactatcatagattttacttatcaaatgtctggtcttgtagttgtagatcaaaaacacttttgcttcatttggtcatgtagttgccaacggataaggacctgtatggatgctgtggttttgagaaactgtattatcaaaaccacggtttacaaaaaagaggtatatagtggagtttctagaagagtaaagttcatcaccggtccctaaacttttattgtcgtgtcatcccggtccctaaactcgcaaattgaccgtttatgtccttgaacttgttcgtctgtgtcatttcggtccctaaacttgttcagttgtgttatcccggtccctaaacttataaatcgcccgtttaagtcctcaaatttgttcagttgtgtcattctagtccctaaacttgattttgagtctcatctgggtcaaaacaaaacgatttaaaaactttatatcaaaaaataattcataactttttcatatgaactcaaatgaagataaactttatatcaaatttgtagccctcaatgcgatctacgactttgtagttgaaaagttttttatttaatatcgtttagtgtcacataattttaaatttctagatctaaaagctttcaaaaaatattttgggaccccacaaagtttcaatttagaaacttttcaactacaaagttgtagatcgtattgctgactacaattttgataaaaagtttattttcatttgagtccatatgaaaaagttatgaattatttttctatatagagtttttagatttgcctcgttttgatccatatgagacttctaaagtttagagactgggttgacacaactgaacaagtttgaggacctatatgggagatttctaagtttagggactagaatgacacaactgaacaagtttaggtacctaaactattgttttgtgagtttagggacaggaatgacacagccaaacaagtttagggaccggtgatggactttactcggaactccaaaaggagtacttttagtaataccatgtttttcaaaaatacaaatctccttgcatccaaacaccttatagtttgtcaaaaccaaagtatttcacaaaaccatggtatttttctaataaagtaacaaaaatacttcaaactaggactaaggtgttttcataggtcggaattaaagtcaagaactcctgaactacatataagacatcaatacttttcagttcatcatcaactagcactctcttggcttttgagactaacatttgcactttttatccaatcgatctgatcatattgctaatatacaaaaattatgatcatttcacatggtttcttcaaattgctttgtccttggtttgtgataaatattacttttttcagtacatttttattaataagatattgtactgttaataggatattgttgatttcttcttgaagaacatggtaaatgagaaactgggtccaataagcaatgctcatgttgttcacgctgatatgagcgagtatggagcaatggatgagaagtgcattcagttggcagaactagcagcaactgctgtagacttccccaagactggcaaaattgtgtcaatgccaccatcccttcggccaaaattatatcctgacttcatgggaaaggaggatgccatctcctataaatcagagaagatccttggaaggctttatcggtcaatccaagaagcctccagtggtgatttggttccagaagaaacttgcacattaaacgatttgccttatgatgcagatatggaagttcctggtgcaactgattttctctcaagtgcttgggagtgcaagtgctcatatgaaacacaactgaatgcactgctcaaccaatatggtgtgcgcactgaagcagagcttgttacagagcacatatggtcgcttcccaaatacagcagcagaaaacagggggacataaaggagagattgaagaatgcatactctgctctccacaaggacttcaggagcattttcgaaagctttgttacagatcaaactgagatctctgatgatgagaaaattcggttttatgagatgaaggcctctgcatggtaccaggtaacctaccaccccaaatgggtccaaaagtcaagggaaatgctcaaacctgactttgaggacatgccagcaaggcttagctttgcatggatcggggtcgagcacctggcacggattaagataaggtgccatggagaagtgaaagtggacagccgaaggcccgttgagaggctcgcagcctacatatctgggagcatgtgagctggcgtgaagctccatgcaatagtgaagcaagaccactctgcccctttctgccatgccatctgaactctgaagcatggctccgcctagtcacttcgtttttttgttttgttttttttacgaaattacatagttgggacacagacactctatatgcacgtacaccgtatacttatctctatgaaccaacattaatgcatttaccagagtcgaacttgtccaaactctattactaccagaatgtttgtggatataaagtattagttcatggtgtctgaattcc

SEQ ID NO: 810 - DNA, 5998 bp, Sorghum bicolor
gtttagatcatccaaaatccaaaaatctttcatcgaatcttgcgacacacgcatgaagcattaagtatagtcgaaaacaaaaattaattgcatagtttatttataatttacgagataaatcttttgagtctacttagtctatagttagataataattatcaaatacaaacgaaagtactacaatattaaaattcaaaaactttttggaactaaacaagacctacgtgagcaaatatgacatccttctagtagtatataagaatggctcagctcgcttttcacacatctaggcttttgatctagtgatataaaggtaattaagatatcaagttaggatcggagctacccacagggattatactctcataaaaagaagatcccactgacatacagttatttgatagtctataggatattcgtgtagtgaatacggctataactctttttttttttttgataatgacacacaaaagaatgtctcatacatgatatatggaggggaacaaagactaaccaattttacttccatagatggactcacaaaactaaatgactatgtttgtaatttaataataaaagtaacaattttttatcatattaaattgaataattatattttgcatactaatcttgtttgagaagacatacacggtatcaatacaacattttaatgcacacgattagtgtaccactttggctcactaaacatatttatatatagatcaccttatcttttcaatagttagtataagattgaaaaacttttcgaactaaatgactcttatacatacatttatctatatttatatttaacataaaattacctaatttggtgaaaagtataagtaccattaatattcttatgatcttcttttttttcttgtatcttaattggtgatagcctgttcgtttggctgaaagtactatttgctaatttattgtgagaaaagtactgctaaatgactgacaaatttgacaaatagactcaaacgaacggactagttagggaatactcatactagaatagggaatctagagttaggtaattattttactgtatttttcccaaaatatacaaggtaccctactttgactcaggctattatagacgaggtactcccattttttttccctcatcacggttcaatccaacccctactttgactcaggaggctatattccaggaaagtctcaccccaaacaataacgccggcctacatttggggaaataatcatgtttgaagagatgaggtctcttcaattttcttacacaattatggttgaagaaacaaagagccttccatttcctacaccaatgttgtaataataaaggaaaaatgagttctttttaagtaaatgacgacggatatactatactgtagaaaatttcaagatataaaatccttcttctccccctcaaaccgacgatataaatccttcttgtcccccgtcataaccaccacttaactatcggggcgcagcagttggcaacccgccgccatggtggtgtcgccggcggagccagtgactacccgtgtcagtgtgggcggctttgactctcgcttcacctcgccgcgcgaactcgccgactacttggaggccgtggccggccgggtctggcgctgccgggtcaagacctcctgcacgccgcccaactcctaccctgacttccagtgcctcccactactccccgcggcgaacgcgcaccagccgccgccgcattattcgtccagggcgcggcgacgccgagctccagacggtgaagacgacggcgcgctcgcgttccaggccgcgccgacgccgtacaatctggtgcccccgcacgccttcgtgcacttcgtgcacccggaggccgcgcgccgcgccgccaggtccgggatcctcgtgcgcgcctcctcctcgtcccagaacaagagcagcgccgccgtccgagaccgcgcggtgcggcgccagaacgccaagccgttccgcttcacgaacgcgcgcgtcgaggtgggcaacctctgggcgccggacgccttcgtcgtctcctggcgctgcccggggaactccggctccagcgccagctccggcctcgacttcgtcgtcgacccgttggacggcagctgtcggctgctgttctcccgtgacaccgcgttcgcgttccctgcctcccgcgaggccgcggtggtgctgcgctgcgacttcaaggttgagtttttcgtcgacgacatcgccgagctcctggtgttcccgaccgatgactcgctgctgctccggctctcggccgcgcccctgctgtactaccgcacggcggcagatggtgtccaccagtcggtgccttttgacttgctggacgacgacgacgacgatccatggatacggaccaccgacatcaccgctagtggagccattggccggtgctggatgtacaggatctccttcaagacgtggttctggccaaagatgaaggacgcactggcgtacatgaaggagaagagggtgccggccgtggtctgcgacattgggtcgccggggttcagggtgcacgacgagccggagtttgggaagccaatgcaggaccttttcttgtgcgtgcagcatgtcgaggagctccagttttcagtcttgttcttggttaatgtgctggtgcataaggggatagtgaacgagcaccagctcacgtccaaattcttctctttgctcaagagagaagaggagcaagtgaatgtggctgcactgacggagctgttaggagagaattctcaggtgtttgatgtatgctggaggctgaaaaatgtgcaggattgggttgccaagaatcccaaactaattcatcctcgcagcaggggcaaggttgctggtgattataatgctgtggtgcggaggctggtgatcactcccaccagggcatattgtatgccgccacaagtagagcgctctaaccgcgtcattcggcactatcatcatgtggcagatcggttcttgagggtaacctttatggatgaaggtatgcagctgctgaacaacaatgcactcagcttccatgccgcaccgattgtccagagcatgatgtcaaaattgttccagcataagacaagaatttacaggcgtgtgcatacacttatgacaaagggtttccacttgtgtggtaggaagtactctttccttgcattctcatcgaaccagatgaaggacaggtcagcttggttcttcgcagaggagggaacaacaactgctgcaaccattagggagtggatgggacagttcccaagtaggaatgtcgcgaagcatgctgctcggatggggctgtgtttcacatcttcatatgcaacggttgtgacacggccgaatgaggttaatgagttgcttgaggatatcgagcgcaatggatacaatttctctgatgggattggcaagatcacaccggaccttgcaatcgaagttgcggcgaggttgccactgatagataggtaccctccatctgcgtaccagattagatatgcaggattcaagggtgttatagctgtctggccaggacaaaatgatgggatacggctttcccttaggccaagcatgaggaaatttgagtctacccactctgtgatagaagtagtatcctggacaaaattccaacccgcattcttgaaccgtcagattataatattgctgatgtccttgggtgtcccagaagctatattttgggaaatgcaggaggcgatgcttaagaatctcgacagaattttgtcagacagagagattgcttacaaggttgtaacaaacagttgccctgagcgtggaaccatcgcaagactgatgctgagtgctggatttagtcctgcaaccgagccacacctgaaggcaatgcttttggctataaagtcctcacagctgaagggtcttttgaagaaaacaaagatttttgtgcccaagggaaggtggctgatgggctgcctggatgaacttggaatccttgagcaggggcaatgctttatccaggcttcatctctatcaatcaacaatcatttcatgaagcatggctcaagattttcctcagcaaacaagaatgcagtgacaattgtaggtacagttgtggttgcaaagaacccatgccttcatccaggggatgtacgtgttcttgaagcagttgatgtgcctgaactgcatcaccttgttgattgcttggtcttcccaaagaaaggtgagaggccacaccccaatgaagcttccgggagtgatcttgacggggacgtctactttgtgacatgggataaaaatcttgtacctccggggaaaaggagctggaaggctatggactactctcctgctgaagcaaaacagctacaacgaagagtacttcagcatgtaagttcaactactctctgcacgtgcacatgattctttcataaaatgtttgttcagttagatgtctgcactgtcaattctatgtttcttttattagttcatgggttttctgtagtactttattttatgtttctgattgctgaaaacatttatcttgcaatgccttaggaatgtattgagaatgtaagttcaattatttcttgtcattgagaatacattgagtacacagcaatggttatgaataacaattgatgttcctcgtttaaaaagaaagtgcattaatttagacaaatacatgtgcatccatgtccatttgacaatataatccttcacagtagtattttcgtagacaaaattaaaatattttggtagcacacaaaaatagtagttctgaaaagtagcagtcagcaaacctgatttgttgagctggtcttcagttcagtctggtttggtcagtcaaaatacaattattatagttttggtttagaaaatccctggtacagttcagctaaatacttttttgtaaaactgaaagttgactgctttggattgttttttattattatttgcactgttagtttagggaactagctgacttaccagatataacaaatttcaagcccattatcaagcatctctttcactttgatttttaaagttcaattattgaatcattatccagttgatcaaacgcatatttattaactaacaatagtaaaactatgactttcacctttatgccatctgatctagttcctaaaaactgcttcttgatttgtgcacaatatttatttatgtagtacatttcattaaaaagatgttgctcttgtcacaggatctcattgatttcttcttgaagaacatggcaagtgagaacattggtcggataagcaatgctcatgttgtccatgctgacattagcgagtacggagcaatggatgagaaatgtattcagctagctgaactagcagccactgcagtggactttcccaagaccggcaaaattgttagaatgccaccatcccttcgcccaacaaaataccctgacttcatggaaaaggatgatgccatctcctataaatcagaaaagatcattggaaagctttaccggacggttagatattatatccttggaatgcccttggaaagtttgatcaaagatggcatgccagcttacgatatcgacctggaagttcctggtgcatcgcatttcttcctagatgcctggcaatggaaatgtgcatacgaatcgcggctgaatgcgctgctcaatcagtacagcgggtgcaccgaagcagagcttgtgacaggggtgatctggtcgcttgccgatggaaggaaaaggaagaagcatgaggcaaacgagaagttcagccatgcatatcctgaactccaccaggagttccgacgtgtctttgaaaatattgcagcagatcaagataggatgtctgatgaaaagaaaaatctagtgtatgagatgaaggcctccgcgtggtaccaggtaacgtatcacccagaatggatcagattctcaagggaaaaggagccgcatggtgaggaaaggccagcaagactcagtttcccctggatcgccatagattacttggcgtgtataaagatgaggtgccgtggacaagcaaagcattttacttga

SEQ ID NO: 811 - DNA, 5946 bp, Sorghum bicolor
aggaggaggagataactccccaataccaagaaacttggcatggagagactctaaccctaaggtctcaatctactagaaaaacttattaaaaaaatgatggatcctctggcgagatgctggaggaggaagcgagggggatcagcgatgatggatgcaagggcggcgacgctagggcgagtcgcaaggttgcaaccgtcattggggacgtgtttgaagacgattgcagcctcgcgactccgcctagtgttgccgtcatcaggggacgcacgaaagactatccacgatgacccgccgcagtagttcttcgggaggacggacgcagtactcgccaattgtggaattggtcatgggcgtcagtgcttcagtagtttatctgtattgtgccattgctgagcgtgtagtataggtgttcaggcttgtctaaggagacgatcgtttcgccgttgccgccattggtgtatgcctgctgctaggcgctatctgggtcgtcgttgacgatctagaggtccacgtagaggataacgtcgctgtccgcttggactcctaggccgaaccgctctagggtgcattatgtccacaagttggacacgagcttcctgtacgactgtcctagtcccaccaggagcgtctcttggttgcgcaaagctctgccacagcacggtgccaccgtccgcgaggagctggaggtcgccggagttgaggaacgggaagacgggtgtgcgcttgccgctagagttgacgggcggcgtccacaacatgttgtcgctgccgttggtgctaaactatccatgagtgcgagttgcctgccctccatgttgttgaatgctaagagcgcaccgtgccgtgttgagcggcttcactggtgggagttagtttgtgaatgttgtggcgtagctttttgcagtcttggttttctcaaattggcaacggttttagggacactattctactttacatacaacgttggagcatgtctcttgggtgcgtaaagctccaccatagcacggtgtcgctgtctgcgaggagccggaggatgccagagttgaggagcacgagcacataggcagcatctgcggcacgttgttgcttctcttggcacggcatcgcccacgagcgcgagctgcccggccgccatgatgctgtggcgagcggcgttgctttgcgaatgctgtggcatagcgttgctgcactagtggcacccggtagtggcaagccttccatggtccacatggacggtttagggctactattctactggagtgcacgacaactaatccggatacgatagatgtctccaagcaagaaccaaccactaattcgacctgtttcagggataccaatgaaatagaatcgacaatggttttagggatcctataatttagtcaaagcaataatttttgtgtatcccttcccttgacacatgcacctttctatatatataactcggtcaagcggtaacctcgctgcagaacaggagtagccgagaagacgaaagcggctatggcggctcacaatcgcagtcgaagccccgagtcaactcgccgtcgtgctcatcttcatcgctctctcaagccatccaagcccaaccaacaccatcctcgtgaacgttgtcgacaaaccgcaggccacccgttgccaggatgcaatttcgctatggtgtggccgacagggcttgcgacgcgggcgatcctgaccggcttcgacgccggcctctcggcgcgtggcctcgcagatgacttggagcatgtggcaggcacggtctggcgctgccgggtcaagacttccatcacgccgcctaagtcctacccggacttccatctacctgccatccttgctgccgcggtgctccacccggacgggccgtcgcggcacggtcgcgtggcccctcacgccttcgtccacttcgagcagctcaaggctgcgaaccacgccggtgacttcttcaagatgcgaatctctgcgcagaacacctacctactacatggccgagcggcctgcccgcgagacggtggcaccgacatgaggcgcccgatgctcttcccggactcgtgtgtcgagtttggcgacatcgtgccgcccgacaccttcttcgtcgcctggcgcgggaccgaccactccgcctcggcagttgacttcatcgtcgacccgtccgtcggttgctgccggctgctgttctctcgcgacactgccttcacgttccccgacctctgccgtcgccccacagtggtgctgtgctgtgacatcaagctcgagttctccgtcagcaatgtcgctgaggtcctggtgttcgaggctgatgactcgctgatcctacggctctcggccgcgcccctcgtgtactaccgcacggcaggcgacgacgtccaagatcgcgtgcccttccacctgatcgacactgacgacgacccgtggatacgaaccaccgatgtcaccccaagtggtgcaatcggccggtgctcggcgtatcgggtctccttcggagcaatgttctggccaactatgaggaccgcactgaagtacatggagaggcagggggtgcctgttgacgttcgagatagccgttggctggggttcaccgtgcttgaggagccggacttcgggcggccaatgcagcacgtgttcttctccctgcggcaagatgaagacctgtggtttccggagctgtacttggttaatgtgctgatccacaataggatagtcaatctgcaccagctgacgtctgagttcttcagtttgctgaggagagcacatgaagatgtcaatgttgctgcgttgacagaattgtttggtgcaaagcttcaagtttgtagtaatccatgctcgaggttgaagaacgcgcaggatagggcgaccaagaatctcaatcttctctttcatggcagcagcagaaagcttggtgatttcaatgctgaggtgcgaaggctgatcatcactcccaccaggacatactgtatgccacctcaactggagcgctctaaccgcgttacccggcattatcatcaattgtcagatcgcttcttgagagttgcttttgtggatgagggtatgctgccactgaacgctaatgcattgagcctccaagtggtgcctcttgttaaggacttgatgtccagccctacccaacagatgacaacagtttacaggcgtgtccaaacaatcttgacagagggattcaccatgtgcggcaggaaatactcgttccttgcattttcaacgagccagctgaagcaaaagtcagcttggttctttgctgaggatggaacaacaactgtcgcaagcatgaaggagtggatggggcagttcccgattaggaatcctgcaaagcacgctgctcgaatggggctgtgcttcacatcttcgtatgcaacggtgacaatgcagccttgtgaggtcgatgagtatcttgaggatgtcattcataatggatacaatttctctgatggaattgggatgatcacgcaggacctcgcgttggaagttgccaagaggttacaactaacagatatctacgccccatccacataccagattagatatgcagggttcaagggtgttgtagctgtctcgacgggacaaaatgatgggatgcggatgtctcttaggccaagcatgaggaagtttgagtctgcacactctgtgttagaagtgctgtcctggacaaagtttcagccatctttcttgaaccgccagattataacattgctgaccagcttgggtgtcccggatgctgttttttggcaaatgcaggaagcgatgctaggtaatctcaaaaggattttatcagacaacaatgtggcgtatgaggtcgtgacaaactcatgtcctgagcatggaagtactgcaggactgatgctgagtgctggctttgctcctgcaactgagccacacctgagggcaatgctattggccatctgcgcctcacagatgcagggtcttttggataaaacaaggatttttgtgccaaagggaaggtggttgatgggctgtcttgatgaacttgggatccttgagcaaggacaatgttttatccaggtctcaacaccatcactcaacaactgttacgtgaaccgtggttcgatatttccatcggaatacaaaaataatgcagagattattgttggtacagttgtaatggcgaagaacccatgccttcatccaggggatgttcgtatccttgaagcggtggatgtccctgaactgcatcaccttgttgattgcttggtcttcccccaaaaaggggagagaccacacgccaatgaagcttctggtagcgatcttgatggcgacatctattttgtgacgtgggatgaaaatcttgtacctcctgggagacagagcggcacccctatggactacttcccggctaaaacgaaacaactaccacgtgaagtacatcaatctgtgagtacatctatccctttcttcattttattcagttgagatgtcctatgatgatagacaaacaatatataaccatggtgataatacttttagtgacaaaaatattggtacaacacaaaaaagatttcttttatgaataaatataaattctatattcactttgtataggttagataaaattctaaaagctaagagtcagcaagcataatgtcctgagtaggtctttggattgaaaatgaattgatgcttggagacaaattagtactaatgaatgctaatacacattatgcttggtatgctggtagtctggtactgtggtatagtggtataatttaaacagctgcaataaaggtcaactacattaaatcagcatcccttttacccttttttttacgaatgcaactctactgcaatgaagttcagctacaataaatcagcatccattttgcgttgtttgaccaatgcaactgatgtcagctgctgccaagttccctttttaatcttgtttatttattgaaatgaaacataaatacacctttagcttacatacatatatggtacctaactgatcagccacatatatatatgactaacatagaaaattgtgacttgcatctcctatcaccttatcacatgatttctacatattgcttcttcctttggtttgtacacaaatacttgttgccataatacatctcgttaatgaatattgtgctcttgtaataggatatcattgatttctacttggagagcatggtaaacgacaaccttggtcgaatatgcaatgctcatgttgttcatgctgatcggagcgatgatggagcaatggatccgaagtgcattcagttggccaaacttgcagctattgctgtggactccgcaaagactggggaaattgtgagaatgccaccatccctttcaccaaaagaatatcctgacttcatgggaaagggggatgccatctcctacaaatcaaaaaagatccttggaaggctctatcgatcaattctaagggaaaatggcgatgattttgtgtcacaaggtacatgcatttcaaatgagactccatatgacattgatctagaagttcctggtgccttaagttttcttgaggatgcttggcaatgtaagtgcctgtacgaagcacaactaaataccctgctcagtcaatatggtctgcgtagtgaggctgagcttgtgacaggggagatatggccactagtcggatataacaagtatcaatatcaattaaaagagaggatcaactatgcatattccaaactccaccaagagttccgaagtatctttgaaagcattgatatctcctattgtgacaacaaaaacctagcatatgagatgaaggcatctgcatggtaccaagtaacgtatcaccccgaattcatccgattaagggagcctgatgatgagaaaacacctgcaagacttagttttgcatggattgcagttgattacttggcacaaataaagaagaagtgtcatggagaaatgaaagttgaagagggaaggtcagcctacattttctaa

SEQ ID NO: 812 - DNA, 6357 bp, Sorghum bicolor
gcacacaggttgccgggttcatcttcgactgcatcgcccgaaaaggcggcgggcgccactgcccgttgtggcaaacatcggactccactgattggcgccatgcatgatcgacggcgatccagttccagtctgccgctgtacgcccatcctgtggcgaaggcagaatgcagcagggatcagagggactgtcctctccacgaagttcaaacagcatcgggtccgaccaccgtctggcggcggagagctgctgttggcaacgacagcaaactccaagtcttggctgcttgctacctttggctgcccgccccggccccccttcgctagacgacggtggcaaaaggcgctcattgccgttgcctgagccctgaaccctgcccagcatccactccactgtcgcgcaaagcagtcgaaacaggtgctttacgaccggcagaccggagaatttagtggccggcggcggaggggctctgaccgtctcacgttctctctctctctcacgcgctcaccctctctcttgcagatacgatacgactcaaagtaacaaccagagggtccggcaactcctcggccgccaccgcgccttccagcatctgcgctgctaatatgcacgttaaatgatcgtcattgtttgagatgatgatagagcctagtgctagaagatggaatgtgtagtgtcaccactaccattactattcatgatgtaataataattacagtagtagtagtaactcattttgtatcaacactatataatgaggatgcatagtccgccggaacgccgggttcggctccatggcgtcgtcgttgccgtcagtcacccctacagcatcgtgtctgtccatggtgtcgacgtcgtcctgctgcagccgtcgttgggccacagctagcacggtgccgccgtccccgcgcgaggagctggagggtcgccagagtcgaggagctcgagcacacgggcgggcggcgtccacagcacgttgttgctctgctcccgtcggcgcggcgtcgtcgcccaccagcgcaagctgcccgtccccggtcgccgtgatgccgtgacgagcggcgtcgctggcgggagtcaggtttgtgaacgccgtggcgatcgagctgcccggcagcgcgcggcgagccctccacggtccacatggccgtttcagggctactattctactggagtgcaacggaataataggatccgcaactaatccggatacgatagataccactaataattcgatccgtttcagcctttcagggatataccataacaatgaaatagaatcggcaacggtttcagtttcagggaaacgtatctacgcagcaggaaacgtatcccttgatagtacattacatgcacctactgtataatttagtcaaagccataattttgcatgcaggtgtatatatcccttgatgatacatgcatctatatatataactcggtcaagctgccaataaatctcgctgcagaacaggagtagtcaagaggagacgaaagcggcgatggcggcgcacagccgccgcagtcgcagtcgcagccccgagtcggctcgccgtcgtgctcatcttcaccgctctctcaagccatccaagcctacccaacaccaccttcacgaaagccgccgcctgcaaaccgcagaccgcccgccgctgggacgcaacaacttcgccgccgtggcgtggccgacggagccggcgacgcgggtggtcctgaccggcttcgacgccggcctctcggcgcgtggcctcgccgacgacctagagcatttggccggcacggtctggcggtgccgggtcaagacttccgtcacgccgcccgagtcctacccggatttccagcttcccgtccaccctgccgacgacgacgacgcagcggtgttccaccaccaggacgagccgtcgcggcacggtgtcgtggcccctcacgccttcgtccacttcgagcaccccaacgccgctgaccgcgccggccacttcttcaggaagcgcgtccccgcgcagagcagctacctactacatggccgggcggcccgcccgccgcgggacggcggcactgacgacaccagggggcggccgatgctgttcccggactcgcacgtcgaggtcggcgacgtcgtggcgcccggcaccttcctcgtcgcctggcgcgggaccgacgacgactccgcctccgcctcggcactcgacttcgtcgtcgacccgtccgccggttgctgccggctgctgttcgcccgcgacactgcgttcacgttccccgatttccaccgccgcccggccgtgctgctgtgctgcgacgtcaaggtcgagttctccgtcgccgacgtcgccgaggtcctggcgttcgaggcagatgactcgctgctcctgcggctctccgccgcgcccctcgtgtactacagaacggcgggcgatgatgtccatgaccgcgtgccattccaccagatcgacgttgacgacgacccgtggatacggaccaccgacgtcaccccaagcggcgcgatcggccggtgctcggcgtatcgggtctccttcgcggcgaggttctggccaacgatgagggctgcgctggagtacatgaagaagcagggggtgcccgtcgacgtctgtgacagccggtgccggggggtcaccgtgcttgaggagccggacttcgggaggccaatgctggacgtcttcttctccctgcggcacgacgaaggcctgcggtttccggagttgtacttggttaatgtgctgatccacaacgggatagtcaatccacaccagctgacgtccgagttcttcagtttgctgaggagggcacaggaagatgtgaatgtggctgcgttgacagaattgttcggcacaaagcttcatcaagtttgtaatgatccatgctcaaggttgaagaacgcacaggttagggctgccaagaatctcaatcttctctcaaacagtagcagcagaaagtttggtgattacaatgtttttgaggtgcggagactgatcataactccaacaagagcatactgtatgccacctcaagtggagcgctctaaccgcgttacccggcattatcgtcaagtgtcagatcgcttcttgagggttacttttgttgatgagggtatgctgccgctgaactctcatgcattgagcctccatgtggtgccttttgttaaggactcgatgtccagctcgtcccaacagatgacaacagtttacaggcgtgtccaaacaatcttgacagagggattcaccatgtgcggcaggaaatactcgttccttgcattctcaacgagccagctgaagcaaaagtcagcttggttctttgctgaggatggaacaacaactgtcgcaagcatgaaggagtggatggggcagttcccgattaggaatcccgcgaagcacgctgctcgaatggggctgtgcttcacatcttcgtatgcaacggtgacaatgcagccttgtgaggtcaatgagtatcttgaggatgtcattcataatggatacaatttctctgatggaattgggataatcacgcaggacctcgcgttggaagttgccaagaggttaccactaacagatatctacgccccatccgcgtaccagattagatatgcagggttcaagggtgttgtagctgtctcgccaagacataatgatgggatgcggatgatgtctcttaggccaagcatgaggaagtttgagtctgtacaccctgtgatagaagtggtgtcgtggacaaagtttcagccagctttcttgaaccgccagattataacattgctgaccagcttgggtgtcccagatgatgttttttggcaaatgcaggaagcaatgctaggtaatctcaaaaggattttgtcaaacaccgatgtggcgtacaagattgtgacaagttcctgtcctgagcatggaagtaccgcagggctgatgctgactgctggctttgctcctgcaactgagccacacctgagagcaatgctattggctatctgtgcctcacagatgaagggtcttttggacaaaacgtggatttttgtgcccaagggaaggtggttgatgggctgtcttgatgaacttgggatccttgagcaaggacagtgttttatccgggtctcaacaccatcactcaacaaccattacatgaatcgtggttcaatatctccgtcggaatacaaaaataatgcagagattattgttggtacagttgtaatggcgaagaacccatgccttcatccaggggatgtccgtatccttgaagcggtggatgtgcctgaactgcatcaccttgttgattgcttggtcttcccaaagaaaggggagaggccacactccaatgaagcttctgggagtgatcttgatggcgacgtctactttgtgacgtgggatgaaaatcttgtacctcccgggagaaagagttgcacgcctatggactactccccatctaaatcaaaacaactaccacgggaagtacatcaacaagtaagtacaactatccctttgttcagtttattattaagttgacacgtcatatatatataaggaaccatctagttagacccatcttaggatgcagaagtgaagaaatagtgtatctaaaatggtcttttttgccttattctttcctgtcttcacatacttgaatgcacactaataaatgcaatatgcttaccacccccatccagaactatgattaatgggaaatatgatcattgtacatctaaccttaattctagcgtcgaaatctagatggatttatatcctttagggtttaagaacattgtattagatggttcaaaacaaaaactagagggacaatctataatatttattattttagatggtgatagacaaacaatataatcatggtgatattattttcaaatttaaatatttgtgcagaatgtttaaattaaaatttttagtgaaaacaatatttgtacaacaccaaaaggttccttagcaatttttaaaaataaatataagtggtatattcactttgtatagttaggttagagaaaattctaaaagcaagtcagcaagcataatgtcccaagcaggtctttgaattgaaaatgaactgatgctcatacacataatgcttggtatgctggtagtctggtactatgtggtatagtggtataattgtaacagctgcaatgaacttcagctacaacaaatcagcatattttttacttcaatcaatgcaactccgctgcaatgaagttcagctacaataaaccagcatcgattatgcaactcctgtcagctgctgctaagttcctttttttaaatattgcttcataaataaaatataaatacacctctagtgcaactcctgttaccagctggctgctgctatgttcattttttaatcttgtttattaaaatgaaacataaatgcacacctttagcttacatacatagtacctaacggatcagtcacatagaaaaactgtgacttgcacctccagtcacctcatcatctggtttctacatattgcttcttcctttggtttgtatacaaaaaaaaaaaaacttattgccatacatctcgttaatgaatattgtgctcttgtacaggataccattgatttctacttggagagcatggtaaatgacaaccttggtcgaatatgcaatgctcatgtcgctcatgctgatcggagtgatgatggagcaatggatacgaagtgtgttgagttggctgaacttgcagctattgctgtggactccgcaaagactggagaaattgtaaaaatgccaccatccctttcaccaaaagaatatcctgacttcatgggaaaggaagatgccatctcctacaaatcaaaaaagatccttggaaggctctatcgatcaattctaatggaaaatagtggtgatttgctgtcacaagtcacatgcatttcaaatgagaatcaatacgacactgatctagaagttcctggtgccttgagttttcttgaggatgcttggaaatgcaagtgcttgtacgaagcacagctaaataccctgctcaatcaatttggtgtgcacagtgaggctgagcttgtgacaggggagatatggtcacttgttggatataacaagaagtatcaatatcaattaaaagagaggctgaactatgcatattccaaactccaccaagagttccgaagtatctttgaaagcattgatgtctcctatggtgacagcaaaaacctagcatatgagatgaaggcatccgcatggtaccaagtaacgtatcaccctgaatttatccgattaagggagcttgatgatgagaaaacacccgcaagacttagttttgcatggattccagttgattacttggcacaaataaagaaaaaagtgtcatggagaaatgaaagttga

SEQ ID NO: 813 - DNA, 7024 bp, Sorghum bicolor
tacagtaacatatagcaacacaaagacacacatccagtcttgatgttagtttgttctagtttctagcaaagtcatttttactgattttttagcatcttacctagtgattcatttgaatttactttatatacacactttccactcaacaaaccgacacaatatcaagaatccactacttaaaattgagcagttattcaaaatgtttcttttccctcttaatctttacaattccacccagactccgcatgcaaaacatgtaggtcatcttacatagttttggccccaacagtgaggtatcatcttataaattatgtgtagtttaagagcatctccaagagcatcatatttttcctccaaaaacatatagttttgcaactctccaagagttgccattaatttactcctaaaatatagaagataattttacatcaagaattttatactatttctaaatcattatagcgacttttatatattctttctctatcatatatttacattaggaatcttttcctattctttattctttctcatacccttccaactgtagattgaccgatcgatacacacatgaaatcagtatccgcgtgaccgcaactatgcataaagttatgtgtgacgagggaggatttaccaagtgctaaattttagcagcatggattcagagttgttagagagagtattttctcatcttactaaaaaccaaggattgagaaggaaaataggatactcttgaagatgatcttaaggccttgtttagttcccaaaagtttttgtttcgggggtactgtagcattttcgtttttatttgacaaatattatccaatcatagactaactagggtcaaaagattcatctcgtgatttacaggcaaactgtgtaattaatttttttttctatatttaatgcttcatgcatgtgccgcaagatttgatgtaatgaggaatcttaaaaagtttttggtttttaggtgaactaaacaagacctaagtaataaactatcatttatcaaaaataatatcaagagccgatagtatcaaacccaatccaaaccatgaacaatccaactttaaaaaaaaaagccgagcctaatcacgctgatatgcgggcctgtccctattttcttggtgctcccgcagttgactcgttgacctcacattcacaaggaaccggcagtcagggtctcacggaggaggcggacggcgggccccactggcagtgccactcattggtcgcgcatgagaatgcagatatcctctcgcgaaggtggccacgtggacctcatcatccgtcacctttcccggccggaggctaccctaccaactgcatctcgggacccactatcctggcccatgcccgtcagtgacttgtgtcgtctgggagatcgaggcggtcgagcgaatcttcggcatgatataatactcgcattctcttggcctccctgtggttcgtttaaaccccacaccacgcccacgccgtagcggagaggagaagagaggaccgagcgagcgatcgatgtcgggctccggcgatcgtcgcggcggcgggcctcctggacccggtgagaacctctctcgcctctccccgcccctcttcgtctcctccctgtggttcgtgggtcgatggatcgcgcaatgcctgatcgtttgagggggtcgtcgagcggggtagggtttatgggggggatttgccgggaattttgtttcgaggatgtgattcgtctcctgcgtgcgggtttggtcgcgtgtatctcggttttgggcggtttgtttccgtgtgtgtgactgcggttttggaggacgagaggagaatgctgcttcgcgtgggtgcggaatcgggtttgtttgggcgttccagttgttcatccgtgctttgtgcggatcctggtgctgcttgtgttgctttttttttatcgttgatttgagttcatctccttggatggactggggggttggcgtattgcgtttgttttggtgggatttagtcttttttttttaacggtggaaaggatttagccatttacttgtacatcctgtgctccgcgaagcagattttgtcaggcctgtgctcttttttttttttgtccttttacgattaagaaatgggtgatctatgagttagtaatcagttagcttatttgttagaaactattgtcatattaaatttaagaaaactattgtcatattaaatttaagaaaatgagtgatctatgagtcaataaacccttgcatttctacaatttcatattatacaacagcaacaaaggatttctgcaatttcatatattatcctaaaataaataagggattaatgttcttatccgtggtagccgtgtttttttaattaaaaaaatgtgaggtgattttattgtgttagtaattgcatgatattttgacggctcttttagttcactgtccttgtgtaatcggtatgtactctttgttttcattctgtgtggttggtttgtgacatttttacaatcattccaatttctgttcgcgagtttggattacgttttgaataggggttcaagttatgttgtgaattttataaaggttttttcgttgttcttagtcaaagtctgatactcattcagttgtctcctcgtaggttacttgcatggttgctggtagtcaattatttttattttttcattgttgctgcttgtctttttaccttgtgttccactttgtttcattctttcattgaggctgataacacactgaataactgaatggtccttgggaaaattatgttactgtgcattggtttgacattgtcgatctggtactctggatatgttcattaacaagtcaaaggcttgatgtatgtgatggcaacatgttatccttactgcatgattgattttgtatgcatttttgttattgttatccatactttgagcctagtgaaattagcaccagtggccaccaattgttatcttaacttgtattggttatataatgacttgcatgtatctcttgacaattagatctttaaatagcttttggtcattacattagctactgatagaactttgatagttgtgaaattactatgttgaatagataaaagtatttttatctctttaagtaatttataacctagttcctgcaactttcctcattgattcattagcatcattatgtttcgtagtggagtatgacgttctttgccattactgacagaaacttgttgagactaatttatctgactctgcataatcttaccctgcatacagatggtggctggaaaaccaaggggaagaactcgaagaaacacgggcaagtaggcgggagccaatggacaccggggagttccacaaatgcgacacctagtacagcaaggccagcatggggtggcaatggctcctcgcacccttctggaaggacttgggctcaagcttcagatcgtggtgctggcaacagatgcaatcctagaccgccaccaccaacactgcgccctgttgtgactccacctctggcaaatggttggcagtggcaatccaggcctcgtccatctggttctgaagtcgagaaggatgatgcttctccatctggttctgaccctgaggtggagaatgttgatggcaacaatgcatcagatgatgatgatgatttgagtgatgatatcagtgatgaatatgattctgatgcaagtgagaaaagttttgagactctaaaaacaaacaagtggttcaaaaaattctttgaaaaattgaatacattgagtgtggaacagataaatgaaccggctagggagtggcattgcccagcatgcaaaaatggacctggggcaattgactggtacagagggctgcaacctttaatgactcatgctagaacaaagggttctaaaagggttaggcttcacagagaattagctgcattgctgggagaggagctctctcgcaggggaacttcagtggtaccagcgggtgaacaatttgggaaatggaaaggactgcaagaaagcactgatcgggagatagtgtggccaccaatggttattgttatgaacaccttattggaaaaagatgacgatgataaggtgactgatcttttttatataatttcatatttatgtccatgtcccttgtcttctggaggttatgatgttttgatattgactaggtaacttggttgtagtattcttttcctgtgatgctaagtacagattttgcattttggttccatctatcccttttaagcataacttgatactacacccctttttagtgcatttgatctgactgtacaaaggtgcaatatgctccgtaagtcgatcagttactatgaatattgtgttatatttatttaccttgatgttaatattcttgtcatgtgtcattctaagttgaccacattgatcctcttcattattttatagctaattgtgttcaatacattgcgcccccacaattttttgagctgagtatggatcataaatgctatccttagatcttatagaagaagtcctttatagctcttcaagggctatacaatgaagttgtattgtattctgatttctgtttattctttgacctgatctagtggaagggcatggggaaccaagagctccttgattattttggagaatatgcagcaactaaagcacgtcatgcatatggtccctctgggcaccgtggtatgagcgtgttaatatttgaaagctcagctgtgggctacatggaagctgaacgtctgcataggcactttgttaatcaaggtacagacaggaatgcatggcagctcaacaaggctcgattcgcacctggtgggaaaaggctgctatttggtttcttagcgagcaaagaggatatggaggcttttaacaagcattgccatggtactgtttcttacaaaactaatgtttctattctgtatatatgcttttttatctggtaaacaacatgatttagtagacttctccctgaattctttatgccttgaataatgatctctgttaagtctgattaaaacatgtacacgtgaaatatattttttgctactgtaatcataaggacaaatgaagttcgatatttctacccttgcacttattgaaatattatatggttattacttttggtaatcgtcttgttcacccactggttatgcatgtttgaatagtattctagtacgtcatgctgcgcttggtcctctccggtctttcctttcctgttacatcctacttataatcgtttttatggtggctgaatgttatgatccttagatcaatggaatgtggcatttggaccgcttcctgataacttatgaacatcgaagcaaaatgcttctttgtgtaccattgttgtcttgtttgtgaaaatacatcacccactcttgactgataaaacattgcccattgtgaatggtgaaaaaattgtgaccgcaggtagtatgacttttcaaacagtacaacagataaatcaaagaaatgggatctgtaacctgtttacagaaatacgaagcctccaagttcaacaagtagtcgagtgtttttaaagtatatacatcaaacttactagttatgttgcatctactgaacaggacatcgagcattttattaacttaattggagacttgctaactatattttcattcatcttcactataatttcaggtaaaagccgtatgaagtatgagatgaagtcttacaatgagatggtcgtgatgcaaatgaaacagatgagtgaagacaaccagcaactgaattacctgaagaacaaggtggttaagacagagcagcactctaaagcagtagaagaatcattgggtgttgttagccagaagctacgtgagactatggaagagaatatatttatcaggagtaaagcaaaagagaagcacttggagtatgagcaagaggtaataaggttacccaagtagtttattttctaccaatgaacatgcgggaatcaacaattttctttttatctaagtctgtgtcaatggctttagtaacaaatgataaagagtttgctgttgctgtgagagtcacacacttctgttttgcacttcaatacttctgtaataagattgatgctgccatcaagatttcaccacctgttgttgaccttgtttccatgctttgcagatgaagtaccaggaggaattttttcatagtcaaattgaggatattcacaaggccacggaggacaaagaaaagctgtttgagaagttgctgcaggaggagcgctcaaaggctagacgatttgatgtagattctggaactaccgaagatcgcaagctaaggtgtctcactaattcatagttggatattaccatgcctaaaaataatgtaaatgctccatctcattgcatgagttgtcaagaactcagggttgcttttgtttcctgcttcaatcatctcatctagacatcataatttcaatgcgcatgtcagttgttgttcctattctcaatccatccatgtcttgtgcaggaaggaacatgtacagaagttcattgattgccaggtcaaggatgtggaaaagtttgaagctgagcgggatgagttgatcaaagtccacgatgagacgaagatgaggctcaagaaagagtacatggagaaggagctggagctggagaaggagctcgacgcagccctgacgggcctgatggagaagcacaagccagatagctttgaggcctccagctcgtaaaggggcttcagcggcttacctcagatcctcatcagcttggaggagcaatcttgtagatgctcctgcttatccataaaagaatgcctagacattctgtagatgttgctaaaccatggtgtccctgtggtggcagcaccgagttatatggtcgccgtagtggtatctcaatcgtattgtgtgcttcgaggatctgaacactgagcgttttgcccgtgatggcatatgggtcaaactacctggagtgtgctttggtttgaatgcgggtgttggttttgcctttcttatgccccggatcattactgattatgttgctccggtcatcaaagtgtctgattcagccatccgaggaaggtcggtttt

SEQ ID NO: 814 - DNA, 7380 bp, Sorghum bicolor
tggtaacaatcttaagtaataccattagtcgtatcaccaaaaaccactttatttggaaattgttaattagaataataaaatatgaaaccataaaaggaaaaaagagctggttcatgaatccacttttgctcacaaaaaacgatgagaagaaattatttaagccactttgcaagtcacacaaaggggttgtaaaacaaatttgtaaattatagtagaaaagtcagggagcaatgaccatgacattttttactatcatgtagtttcttcaagtaaatattctccacacagttccaaggaaatagaaaaacatagaacaaaactagtacattgacacaatccgatacaataaataacatacaacaacacaaagacaagcacccgaccttgatgttagcttgttctagtttgtagcacagtcaacttttattgatttgttttagcattttacctagtgatccatttgaattactttatataaatactttgtgactcaacaatttgacataaatatcgagagatcgagtaatatccagaacattcttttccctatatatcttcacaatttcatcgagactccgtatgcataatgtataggtcatattacatagttttggcctcatcagtaaggtatcatcctatcatttatctaaaatatcatgtgctaatagtcttaagattgggatctgagggggggggtgcaattttgtagatgctcactctccatcacttattgatgaacactcatcctataacctattttcccctcaacatcctaggttgaagaagaggggaccaaaacgtagcaaacacatgaagaagtacatgttccactaaggccttgtttagttcaccctgaaaaccaaaaagttttcaagattccccgtcacatcgaatcttgtggcacatgcatgaaacattaaatgtagacgaaaataaaaactaattacacagtttagctgtaaatcacgagacgaatcttttgattctagttagtccatgattaaataatatttatcacaaacaaacgaaaagtgctacagtaccgaaaagttttcacttttcggaactaaacaaggcctaagaaaagaaacaccttcggcatgaaattctcttggcctggtcctcatcaaatgccaccgtacagatcatcaccaaatgaaagtcatatcaaacccaatccaaaccatgaatgatccaaatcgactcactaaaagcctgagccaacgttaaccagctgacatgcgggcccgtccccataattgaatcgcgcatgaatgcatgatatcctctcgcgaaggtggccacgtggacctcatcattcgtcaccttcgccggaatctaccctcccgactgcgcctcgggacccactatcctggcccatcccgtcagtgagtagtgtcgtcggtgagaggcggatcgggcggcgagcggaacgagcactcccgcgcgcacctctcgaggggtggtgccgtccatatgacccgccccggcggccccctgttccgcacttccgctcactgccaaggcatctccattctccactgcaaatcgtaaaaccccacgacgctgtagcggagagaaaagggggagcgcgcgacgcgaacgcgatcgatgtcgggctccggcgatcgtcgcggcggcgggcctccgggttccggtgagcacctcccgcctcttccccccctcctcttcctccctgtggttcgtgggtcgacggatcgcgcaatgccggatcgttcgagggggtcgggtagggtttagggtggatttgcggggaattttgtttcgcggatctgtttttcgtctcgtgcgtgcgggttggtcgcgtctgtcgctcgatttttgggcggtttgttgcggagtgacgggggcttttgggggacgaggggcgaatgctgcttcgcgtgggtgcggactgcggaatcggtgggggttcctttgtttgggcgttttagtggttcatctatggtgctgcttgtgtggctttttttttatgttttgttttgattttcatttccttgtatggattttgtggttggcggattgttcttgattttttttattgcgtttattttcggtgggatttagccatttacttgcggatcgtgtgctccgtgcgaagcagattttgttagccccgtcctttctttttttttgtccttttattataagaaatcggtgatctacgcgtcaataatttgttgcttatttgttagaaaatattgtaatattaaatttaagaaatcggtgatcgatctatgagttaacagatccttgcatttttatttttattttctacaatttcatattaacctaaaataactaagggattaaaagttctcatccttggttgttggttttttttctaattaaaatgttaggtgattttaattgtcttagtaattgcatgatattttgatgcctctttcagttcgctgtccttatataattggtatgtactcttagtttttattctgtgtggttggtttgtgacatttttacaatcattctgatttctattcacgagttcggattacgtcttgaaaggggttcaagttatgttgtgaattttataaaagggtttttagttgttcttagtcaagtctgatactcattcagttgtctcataaggttacttgcatggttgctggtagttaattttttttttcattgctgttgcttgtctttgtagcttgtgttccactttgtttcattctttcatggatcctgataacatactcaataactgaatgattcttgcgaaaattatgttactgcacagtgcacatttgtttgacattgttgagctggtaaacttctgcctatgttcattttaacaagtgaaaggcttgatgtatgcgatttacttgtgtgatggcaacgtgttatccctactgcaggattgattttgtatgcatttttgtgattgttatgcatactttgagcctagtgaaattagcatcagtgtccaccaattgttatcttaacgtgtattggtcctataatgacttgcatgtatctctcgacaattagatctgcattagcttttggtcagtatattagctactgatagaactttgaagttgtgaaattactacgctgaataggtaaaagtattttatttctatattttataacctaattcctgcaactctcggcactgtttagttagcatcattgtgtttcgtagtggagtatgatgttatttgccattactgacagatacttgttgagatcaatttatctgacactgcataatcctaccctgcatacagatggtggctgggaaaccatggggaggaagtcaaagaaacaagggcaagtaggtgggagacagtgggcatcatggaattccacaaatgcgacacctaacacagcaaggccagcatggggtggcaatggttcctcgcacccttctggaacgagttgggctcaagcttcagaccgtggtgctcctaacagatgcaatcctagaccgccaccacaaacagtgcgccctgttgtgactccacctctggcaaatggttggcagtggcaatccaggtctcgcacatctggttctgaagtcgagaaggatgatgctcctccatctggttctgaccctgaggtggagaatgttgatggcaacaatgcatcagatgatgaggatgatttgagtgatgatatcagcgatgactatgattctgatgcaagtgagaaaagttttgagactcgaaaaacgaacaagtggttcaaagggttctttgaagtcttgaatacattgagtgtggaacagattaatgagcaaactaggcaatggcattgcccggcatgcaaaaatggacctggggcaattgactggtacaaagggctgcaacctttaatgactcatgctagaacaaagggttctacaagggttaggctgcacagagaattggctgcattgctggaagaggagctctctcgcaggggaacttcagtgataccagcgggcgaacaatttgggaaatggaaagggctgcgagaaagcactgatcgggagatagtgtggccaccaatggttattgttatgaacaccttcttggaaaaagatgacgatgataaggtgactcatttttttatatataatttcatattagcagtattttttcccctgtgaaatgctaagtacagaatttgcatttgggttccctctatcccttttactcataacttgacacttatgcatcttcttagagcatttgatctgactgtacaaaggtgcaatatgcttcctaagtggatcagttaccatgaataatgtgttatgcttatttacctagatattatattcttgtcttgtgcattttaataatgctgcttagaagaggtgcaatatgatcaatgctgcttagatcttatagaagaagtccttcatagctcttcaagggctatacaattaagttgtattgtattctgatttctgtttattctgacctaatctagtggaagggaatggggaaccaagagctccttgattattttggagaatatgcagcaactaaagcacgtcatgcctatggtccctctgggcaccgtggtatgagcgtgttaatatttgaaagctcagctgtgggctacatggaagctgaacgtctgcataggcactttgttaatcaaggtaaagacaggaatgcatggcagctcaacaaggttcgattcgtacctggtgggaaaaggctgctatttggtttcttagcgagcaaagaggatatggaggcgtttaataggcattgccatggtactgttttcttacaaaattactctttctattttgtgtatgcattttttatctggcaaacaacatgatttagtggccttctccctgaattctctatgccttgaattattactgctttctattctgttgttttcctttctgttttacatcctgtttaatctatgaagtaagcagggtttttttggtggctggaacataacatcagttttatttcatttaagttttaaaatgcatcactagatgctctgtttggatttgttccttttcaagagcagttcatatttctaaatctggatgcagcgcttagattaaagcatcttgtttggagagcaataacagcaaaatctcactaatatttcacaatgcgtccaccaactaacttaatccacagtggagcacaacttaaaatggcacgtatttttaaaaagaacgatactcaagctgtagatttccttctttttataggccaatcaatttctggtttagtgcagctcccttcttcgcgggcctgcttgtgaaggcaagatttctctatgaagttttggaatgtggccttttgaactaaatcatttggccattagaccgcttcctgataacttacgaatcattgaagctaaatgcttctttgtgtgccatttttatcttgtttgtgaaaaatgaaaatgcatcaccactcgactgataaaccattgctcattatgaatgggtgaagaaattgtgaccacagggactatggcttttcaaacagtacaacagataaatcaaagaaccgaaatctgtgtaagataatctgctgctctgcttgattgttttgctgcagcagggattaggcaataggtcatctcttgctgtccatctacattctagtcaactctagcagtatggcaataggccaaccctgtaatggcttacctcagccatgtctaagttggaggctgatctcagccaggtactggtgtaccttgcagttggtatgcatctaccactacatgtatatatattcaatcaaaatcaatagaggagccagttcagttgctggttgctgcacttgtttgtgctgtgtctgtgctcaacctcttcttctacctccagccaagtgcgtgttgtgtgtttgaggtggtgctcacctgtgcaggctggcccgatcccaacaatctgtaacctgtttattcaaatatgaagcctccaagttcatcaagtagtggagtgttttttaatacatacatcaagctgtactggttatgttacatctaccgaacaggacatcgagcattttactaacttaactggagaattgctaactatatttttatcttcactgtattttcaggtaaaagccgcctgaagtatgagatgaagtcttacaatgagatggtggtgatgcaaatgaaacagatgagtgaagacaaccaacaactgaattacctgaagaacaaggtggttaaaacagagcagcgctctaaagcagtagaagaaactttgggtgttattacccagaagctacgtgagactatggaagagaatatatttgtcaggagtaaagcaaaagagaagcacttggaatatgagcaagaggtaatatggttacccaaatggttatattttctaccaatgaacatgcgagaatcaacaattttcttttaatctaagtctgtgtcaatggctttagtaaccaatgatagagtttgctgttgctgtgagggtcacacttatatcttgcacttatacttctgtgataagattgatgctgccatcttttgatttcgccacctgttgttgaccttgtttccatgatttgcagatgaagtaccaggaggaattttttcatagtcaaattgaggatattcacaaggcaacagaggataaagaaaagctgtttgagaagttgctgcaggaggagcgctcaaaggctaggcgctttgatgtagattctggaactacggaagatcgtaagctaaggtgtgtcattaattcatagttggatgttaccatgccttacctgcgactggaactaaaaataatgtaaatgctccatctcaatgcacaatgcatgacttgtcaagaactcaggattgcttttgtttactgcttcaatcatttcatctagacatcataatttcaatgcccctgtcagttgttgttcctattctcaatccatccatgtcttgtgcaggaaggatcatgtacagaagttcattgattgccaggtcaaggatgtggcagagtttgaagctgagcgggatgaactgatcaaagtccacgaggagaagaagatgaagctcaagaaagagtacatggagaaggagctggagctggagaaggagctcgacgcagccctgacggtcctgatggagaagcacaagccagatagctttgaggcctaaaacattgtgtccctgtggtggcagcttgcgtgatacggagacgtgaccagcatcgcgttatattgtcgctgtagtagtatctttcagtcgtagtgtgtgtggttcgagcatctgaagttctgaacacagtgtttgcctgtgatggcatatggatcaaactacaactggagtgttatgtcatcctctatgggcgtgcgactgtcgaagtgcctaattcagctattaggattgacctgc

SEQ ID NO: 815 - DNA, 3800 bp, Sorghum bicolor
ccccatgcctacgcccgcgctcaccacctccttgtgcgtgggcatgactgatgctacggcggatccgccggatctgacggcggcggcggtagcggatctgtgccaggtaggcctcctcctctctcctcgtcctcccatatctagcggcggtggatctgtgctaggtaggcctcctcctctctctccttgtccttccagatctggcgacgatggcagtggcggtggatctatgtcaggtaggtctactcctctctccttattgtgccaaatctggcaacgtcggtggtggatatgtgccaggttggcctcctcctctcccgttctcccaaatccggcgacggcggcggcagatctgtgctaggtaggtctcctcctctctcctctctctcctcctcccgaatctgctatctagggttccaagaagctctccttatcatctcttccaactccggcggattatagaatggccaattgggagaggcatgtaggctaggtggtggggatgatcgacgggcggtttaggggagccgacggctgtaggggtagtcgggctaggtcgggacaggggaagcttcaattatggtggcgacaggagggtagagggggagaaggttggtgccgtagtcaagctagggtttcacaggagatccaaggtcacggtcgtggctgtgactgtgatgctctggtgaactgtagcttgctgcgcggagacggtggtggtggcgcggggggggggggggggggggaaaaagggtcccttaaattttggaaaaaaaaggtccttgtttttttgtgtgtgtaaaatgttgtgcaaggtgtatgtgcagaattttttaaatccggattcttagactcctgtgctaactaaatattgagcctcttcgcttaaacttatctgctaaatttggcagcattatttttctcttataacaaatcagtcgaacggtattttcagtcatgacgtttcagacgcaaacaagttcaattaccttaggccttgtttagttcccaaaaaattttgcaaaatttttcagattctccgtcacatcgaatctttagatgcatgcatggagtattaaatatagacaaaaatagaaactaattacacagtttggtcggaattgacgagacgaatcttttaagcttagttagttcatgattggataatatttgtcaaatacaaacgaaagtgctacaatatcgatttttcaaaattttttgaaactaaacaaggccttagttttcggctagcactagttctctttggaaattccgtgggattgcaaatataagcacgaagaagccctcgtaggcaagcactgattctctttggacattctggggaatcgcaagtactcgtatcacgtactcgagttgtgtcattgtagtggagaagccgcacggccgtgcttgcgtcattggctcgttgcgtgtcattgtgtgcagtgcagtgtccacccctccaccccatccgcatccagccagattccagaccagacagggccgcggctttcacgccgctcggacacccgcaacacctgaccggagagagagggaggcggagaagaaaggggaaaggggaccgaccaggcgaagccggccctcggcaatggagacctctcctcctcctcctcctcctccgccgccgccgccgcagatcgatcatcttctctcgcaattccccatcatccccaaacccgatcccgacggcccaacccctgcgcaaacccccgcccccatcgcagaacggtcggcggcgctgatgctggcgctcaccccggagctctgccaggttctccaccgggagcttgctccttcccccgacgacgatccctacttcgctcgctgccttcgccaatcccagctccacctcgaagccctcgccgccagtctccgccccccctcttcctcctcctcctcctcctccgccgccgccgccgccgcatcccttgcacgagtccttcctccgcctcctccccctcagaaggagttgcggacgcagctgcaacgagaaccaggcgcaggcggcggatccaacccctccagctccaagaagcgcgcgcgcgcctccactgaggtggtgcgcgccacccacctcagccccgcggaccatctccgctaccgcgccctcgtccgccgcgcgcgcctcaccttcgaggcgctccgcagcacctaccagcgccaggagacctccagcggcgtccgcaaccgccatgacctccgcgcctccaggcagatgctctccgctggccactggctccaccgcgaggtccgcatcgtcggcgatatccccggcgtcttcgtcggcgacgccttctactaccgcgccgagatctgcgtcgtcggcctccacaccatgcctcaggccggcatcggctacatccccggcagcctcctcaacgagggcgaccccgtcgccactagcatcgtctcctccggagggtaccttgacgacgaggacaccggcgacgtcctcgtctataccggcagcggcggccgccagcgcaaccgcgtcgaccaccacgccaaccagacgcttgagcgcggcaaccttgcgctccacaacagctacctctacggcgtggaggtgcgcgtcatccggggccacgacatcgaccaaggtccgcaccgcaaggtctatgtctacgacggcctctacagggtcattgagtccaccttcggccccggcaagtccggccacgacgtctgcaagttcaagcttgtgcgtctccccggccaggacgacctagccagcaagacctggcacaccgccaagctgctcaaggagtccatggacgccagaatccgcccgccaaggtacatctccctcgacctctccaagggggctgagcttcttcgcgtccctgtctgcaacaaggtggacaatgacaggtctcccctgctatttgagtacattgcccaacctgagtttccagtgcggccagcgcacgtgccagtcaagcagcacggcggctgccattgcgcggggggctgtggctccaagtgcagatgtgagaggaagaacggtggagagccagtgtatactgaggatgacattctggtgatggggagaccggtggtgtatgaatgcggtgctctgtgtgggtgccccatgacctgcgtgaaccgtgtgacgcagcgagggatgaagcaccggctggaggtgttccgctccattgagacaggctggggtgtcagggcgcttgacttgatacagccgggagcgtttgtgtgtgagtacactgggcatgtggttgttatggatgatcagccaggcagtgcattggagggtcgcagcatcatcgatccaaggaggtttccagagcgatggaaggagtggggagacgcctcggctgtggaaccaaacatgaagagactccagtttgcaaagtttgcaggaccaggttatgttcttgatgtgtcacataagaggaatgtggcctgctacattagccacagctgcacacctaatgtgtttcttcagtttgtattgcgtggcaatgaggacgagtcgttccctcacctgatggtttttgccatggagaccatcccacccatgcgtgagctgagcattgactatggaattgatatggagttgagtgcaatctgatgctggttctgaggcatcaatgtggggaaggcaggcttactagactttttggatgatagcgtaggcgacgattttttttttggggggaataataaccatacatgatacactggtttagttttgccctagtttgcacccttcaatagttaaattctagaattcagagtgacagagtatcaaaaggtgctca

SEQ ID NO: 816 - DNA, 10581 bp, Sorghum bicolor
gtcatagcatgatgaatatgatgtttcgtgcttttaaaaacgaatcagcccaacaataacgtgcccggtcaaaaggtgcaatttgcatggagctagtatatagtacgtaccaagcgacctgtagccaggcgaggaggacaccgcagcaccggccggtcggcagccagctgctagcttccagcagaaaaccctcctgcctccgggcacagggcgtggtcaggcctgtcgtagcagccgcgcgcctcgggatctcgtacgtgccgcatgcccaacggccgcgtattcgtacgtgcgaaccgatctgagtgcgcgagatcgagaggacgagacgatcgaatcgagagagcgctgctctgtgccattgccacatcgcctgcgcacgtacggcaacgccatgctagctttcttccccaccgccaacgaccaacccgcggaacgctttcacggagacggcaagtgcgtaccctggcccgcgcgagatgccgagtcctcggcggcgaaaggaggcttcgcgcgcgtccgcgctcgccattggcgggacgtgcgcctgcgtgcagcagcccccccgaccagctgctcctctctctgtgacaggcctccctgcagcgcctgcagccagcccggccgggcatgcggccttgtaggcatacgtgtggtctctccccagcagagagacgagactgttcaactgttaaattcattcaaacgggcatttgtagttcaaataatgggttcccaaaaaaaaaacgttcaaatggagcagggatgcaagctggtgcaaatcgaatactatgtttaaccaagaaactaaatttgattatcgaatctgattgttggggtatttgcataacactgtctactagtattattcgatctgcttgtaataaccacgcgtgattttatgtgactaggtgttgagaggaagtgaggaacaaaagttaacttgatatctggaaaacctgaggggctaactgctattcatgcccccaaacatgccaggcaacagtcttcaagggcaaaaaggtctattctcacgccactcctttgagctgtccatgcatgcgtgcaccatgtccatatgcacccatgcaccacccaccacctgcatccaaagcatccagctgatcttaattaattaacaaagaccgtgggccctactaaagaattaagaaagacctaggatccagtggcttctcttgcattaattaatattccttgatcatcaagtcagtcgctaatcaggattaggcgctcgtacggacacacgcagagcccgcggtaaagctaccgttgcggtgagtggagagtggagacggcgtacgtgctccacgccccggttcatggctcctagggtttcctcgccccctccgcctatatagcagccctcttcccccctcacctgctcacccactccgctctcctctgctttccctcgttcctatccactgccaaggggaaccaccaaccccacagagcctctgcttcaatccttcttctcccatggcttaccgcggcggcggccgaggaggaggccgcggcggcgaccgcggggaccagcgcccgccgtacggccacggaggagccgggggatccggaggcggcggcggaggccggcccttcatctggccgccaccgccttccacgccgcgcccggtgatgccggcgccgccgccggggccatacccggtcccggtgccgatgggcggctaccgcgggcccatggtgatgccgcacccgggcgcgtacggggttccgatggccgtgtaccggccgtccgggcaagcggccgtgttcagggcgcccgcgccagcggcgccgcaggtctccttctcgcctgcgcctccggcagctccggtcaccatcagggcgccgccaccatcctcgaagacgacgtcgccggctgctccgtcgtctaccactccggcgcctccacgccagtccgcgcggcagagcgcctccacgccggcgtccgattcggctccggccgcctcctccgcgccgtctcccgcggcggccctggcgaaggaggtggagaagaagctgttcgtctccgagaccgcgctggcgccgcctgcgtcggcggcgcatgggacggctgctgcccgcgcggacgaggcgtcggacctcgacctggcgccggtctccaagaaggggctggcgcaccccgctcgcccgggcctcgccaccgtggggaagaaggtgatgatccgcgcgaaccacttcctcgtcaacgtcgccgacaacaacttgttccactatgatgtgagctatcccctcctcctccccatctcccccctcagctactagtactagtatcttctcgtatccatgcgtgcttggtaagatctggtagtcctgtgcgcgcgcgtgagtctgagatatggattggtacgagcatgacgtgataacatgtgatgatgggctctcgttttggttcttgctttttttgttcttgatctgtcagatccagtgtttctaatgctagcttgttcttgtggttttctcgtttctgtggaacgttggcgtactagcacatgaacatcttgcgcttccagtgtgctacatatgcacgttcatgtggggcttctgttcgtacgtggctctctgcgccaaagcctgtgttttctctttgcttcggtttcttgtccatggtgctggtgcctcggtgatgggactgctattcatctagccatctctctacagtccatgagaggttgttctgcaatcagcacccacgcttttggaaagaaatggcaggctttctctgctgcgattttctgctctgttttttggactgttgtttcttgcatcgaggaagtggactgcagatcagtgccgttccgtaaaaggctcttgccagaacatggaatcggaaaaaccattgggcagatgcgttggaaatcttgcatctgtttggtgcgtcttctttcgtttgctgtcgtttgagcacaagctttctcagctttcagcagtagggcgattttcttttctcagttttttgtttggcactctctctctctctctctctcggtttgcagtgggcctcgtgtcgtgcaacacacatactccaaaacgttccacaatgttgcgcagaaaggccccagccgtgtcttgatctcttttgctttttattctttcctttctgaggccttgtttagtttccaaaatttttcaagattctccgtcatatcgaatcttgcggcacatgcatgaagtattaaatatagacgaaaataaaaactaattacgcagtttacctgtaaatcgcgagacgaatcttttgatcctagttagtctatgattagataatatttaccacaaacaaacgaaaatgctacagtagcgaaatccaaaaatttttccaaactaaacaaggcctgatttgccagatgcagtttttgtgcttcttggttttatctttttgacttgagcttaggccttgtttagttccaaaaaattttgcaaaacaggtactgtagcactttcgtttgtttgtgacaaatattgtccaatcatgaactaactaggttcaaaaaattcatctcatcaattccgaccaaactatgcaattagtttttattttcgtctatatttaatactccatgtatgcaattaaagattcgatgtgacggggaatctgaaaaattttgcaaaattttttgggaactaaacaaggccaaatgtatacatggaacttgctttcagttccatatttgtggttcttgcttgtgtgagagatggccattcattcccatgcatgaagcaagatctgcagaagcaataatgcagatgcatcgtcatatgatgcagcagatgcgcatccatgaaccaaaatccctgcagcttcttctgacacggttgtaccaagtggggttggggatgtgtcctatcgtttgcctgccattggagtagaagcttttgatgaaacagctgctgcgttctcttgcagcattgtagtagatatttggcatcttgttacctttgtccgctttttggttgttgtttctcttccttgcgatctcttgtaccagctgaacttttgattttagaagacggtcagatccattgtggggtttctacagtgagcctctccatgctgttctgcagcatatagttccaaagttggtcaggagacctgtctgtacgagaggggagattctttgtgttgtttcctttttggaactcttcttggaatctccgattgaccatacaaaatttaattaccttgtccttgtacgagagggacggcggtaacttttctttggtacatattatttgctgtgctatttgaacgaagtaaattctcggccgtaggtttctgagtgaacttcgttttataaatgcttgatttttttcgaaatttttagtagtcaatttagtgtattatagatgaaattttattatcactgcagtaaattttattttcactgcagtaaatgtttgaatgaactgtttccagttaaagcttctttaaattagtgacctgtttgctatatctgagttgcttcagtacggagtacctccctttcttccagttgcttttatcgtcttttctgtcctgttactaaacaagtgtagggtgaatgtaaggccttgtttagttccgaaaagtgaaaacttttcggaactgtagcactttcgtttgtttgtgacaaatattatccaattatggactaactagaatcaaaagattcgtctcgtgatttccagataaactgtgtaattagtttttgttttcgtctatatttaatgtttcatgcatttgccacaagattcgatgtgacggagaatcttgaaaactttttggttttcagggtgaactaaacaaggcctaaagagtaaaaccaaacaagcccggcccacggccccacttcgtcccccaaccccacaacacccgcgcatctctctctacccaccgccgcggcagagctcggatcaacgcatcggccggcggccctgcgattgtcgatgtgtcgccgggaagccacgcctctcccctgccgcagcttatagcagtgtagaagaaccctagtcaattcgctcgtttccgctgccagattgggtccacgccgctggatctccatggcagcacaacaaattggcttcccaggttctgccgcacaaagcaaccaaaaccatggccaccacccaaaatgcaaatgctcttcaaaaccacagtagtttaattggctcgtcaatccacctgtaacttgacaatttccttcatactttaatgtaagttgcttctcattttcttaaccctaggataagtgacatgtcatactgtcttgtttactgaatctaggatgagaatttcattattcttccactaaggatactaattttttagtgtttatttgtgtgctgtgatgtgtgaaaccatggtctagttgatctcaacaaaaagattatgattcattttgcctggcatttatgtgtcttttaggtggctattaatcctgagtcaaagtcaagacaaaccaacagggaagttctgaatgagcttatcaagttgcatgggaagacagctctgggtggcaaactgcctgcctatgatggaaggaagagtctttatactgctggttcacttccttttgaatcagaggagtttgtggttacgctggttgatccagaaaagaaggacaaagaaaggtcttcccagatcctattttggtccacttttcagtactacatgaaagttatttctcccctgcatatgttaatgtttttcaatttatagggcggagagggagtacaaaatcacaattcgtatcgctgggagaacagatttgtaccaccttcagcagtttctgcgcggaagacagagggatatgcctcaagaaaccatacaagtacttgatgttgtcctcagggagtcgccatcttggaagtataatggctaaacacaatttcctgcttttaattttgctttagtaatcttttatcctggttactgacaaatttttggttaaatgtcgctgcagttatgtcacagtgtccagatcctttttctctactacttttggccaccgaggcgacattggcgaggggcttgagtgttggaggggttactaccaaagcctgcgcccgacacaaatggggctttcactgaatataggtaatactctgtctatcttgttgttggcccatgccttttatttgataatatgttttggtaattaacattggttttaatgttgccttttgcagacatatcagcaacatccttttttaagcctgtgtcagttatcaaatttgtggaggagtacctgaacatgcgtgatacatctcggcctttgtcggacagagatcgtgtgaaggtaatgttttcacacactgacaatctagaaagcttcttgtacagtacatcctcctattggctcgtttttgttgagtaatcttacatgacattaattgtgttcagataaagaaagcattacgtggagttcgcattgaaacaacccaccaacaggatcaaatcagaagatacaagataacaggggttacttccatccctatgagccagctgatgtaagtatctatatgcaaatgctgcctttcttttctcttctctctacagcatttacgttctggaatattaatgctaatattaatcattgcatggtatgccttgagtttgagtattttgtgcatgtttgtatgtgggtaggcaagttataagacagggtctaggagtaacaaatattttgagagaatattaattctgaattactggcacatcacttactaactgctaaatagttgtagattacaattaatacaatttgaacaatctgatatgtcaacactgtgtcatcaacttaccgctcctttttgtcattttagatttcctgttgatgataaaggaacaagaaagactgttgtgcagtacttctgggacaaatacaactacagcttgaagcatggttcttggccttgtcttcaggctggcagtgattcacgacctgtatatttgcctatggaggtactgtatccatgatcattcagcagtacttgaattattcatgttatgttcattgttttaataaaaaaatgttataggtttgtaaaattctggaagggcagagatactctaagaagcttaatgacagacaagtgaccaacatacttagagcaacatgtaaacgtccccaggagagggagcagagcatacatgatgtactcttctggacccttattcctctgctgtttataatagaataattattatctctgcaggatatcgtttctaatgacaaattttcttatgtgctgcatagatggttctgcataacaagtatgcagatgataggtttgctcaggagtttggcatcaaagttagcagtgatctagtgactgttccagcccgtgtgctgcctccacccctggtaacttggataattttgttttccttgctcaaagattagtgtccaggaatcacctttgttttattctttgaggaataatcagttcctttgctgtatttcagttgaaatatcatgagtctggtagggagaaaacctgtgcgccaagtgttggacaatggaacatgatcaataaggtgagattatgttcttacctagaaatttgtctctgaagttagttgagcattggcatacttgtcaataagttcattgtgaacttgtccagcatctttgtgcactgtttgtcaatcgttgttttgctgggaaatgtttgtcaagcttttaggagtgtctttttgtttaatgctgaaactatcattaccaaattttctagccagtctttctagatgtaacaaagcttttgaccactgttctggtacccttttctagaaaatgatcaacggaggaactattgataactggacttgtttgaacttttcacgcatgcgacctgatgaggtacagaggttctgtatggatctgattcatatgtgcaatgcaactggaatggtaagttctttactatctgattccagacagttcagtatatattgaggttaacttctaatcatccctgtaggttgtcaatccacgtccatttgttgatgtcaagtctgcagctcccaaccatatagagaatgctttgagagatgtacacaggagagccacacaaatgcttgcccaacaaggagtgggaaatcagctgcagcttctgatcgtaattctgcctgatgttagtggttcttatggtatgcataactgtctttcggtctgggtcatacacacctttacaatttattaggatttttgttatataaatgactctcctacttttgcaggtaaaatcaaaagagtctgtgagactgacattggaattgtatctcagtgttgcttgccaaagcatgctagcagaccaaacaaacaatatttagaaaatgttgcactcaaaatcaatgtcaaggtccgaaaacctatattttttgcaataagtttttttgttgttgtctttttttgcaggaatttattaattcctttcatttaagcaggttggtgggcgcaacacagttcttgagcgagcctttgtacgcaatggcataccctttgtgtcagaagtcccaacaatcatctttggtgcagatgtcacacaccccccaccaggagaggactctgcctcatccattgctgctgttagtttctttttataattgtcaagttatcaatcatatttcagttgtatgatttgcttacaatgtttttggaacattgatttgcttacaatgtggtattcctcttcataatttagtgcaatctgagctatgtaaaaataagttatcatgttgctgattataactttcgttgaaattgtgtaggtggtggcatcaatggactggccagaaatcaccaagtacagaggcttggtttctgctcaaccacaccgacaagagataatagaagatttgtttactgtcactaaggatctgcagaaggggcacagtgttaatggtggaatgatcaggtaagtttttgattgatctgagtttgtcctattgttagttatcaaatggtttatctgggtaactgacatggtcttgtttgcagggagctactgattgctttccgcaggaagacaaacagaaggcctgagaggataatattctatcggtatgtgttccagattcctgtttttggttcattttttctacgctattgagtgatgaagtatgttgatttatcacgcctatacagggacggtgtaagtgaaggtcaattcagccatgtacttcttcatgaaatggatgccatcagaaaggtatgattaccagcatcataatttgtctgtcaaatatggttttctttgtcatatgcccatgtcaatggttgtgtccctttccttttcaaggcttgcgcttctttggaggagggatatctacctccagtcacatttgtggttgtccagaaaaggcatcacacaaggcttttccctgaggttcatggaaggcgtgatatgactgataaaagtggaaacattcttcccggttagtgttttggtgtcacactgctattgagttcatatagctgctgcttctgtaagtatttgctgatctggggttattttgtgccttgtgctgcaggaactgtggttgaccaacagatttgccatcctactgagtttgatttctacttgtgtagtcatgctggtattcaggtatgttggtacctcggtgcacattcttttccagaacaccacttgtcagatattgagcgtcaaaattattttttgtcagggaacaagtcggcccacccattaccatgtcctctatgatgagaatcattttactgctgatgcactgcagtcactgaccaacaatctatgctacacgtaagttcaactcctcttcactcttgagtgctctttctctctctgactctttggcttacctaacatctgtctactttaattgatgaaatgcagttatgctcgttgcacccgtgctgtatcagtgggtaagttcttattctagctgctcttctgtttcctatcataatctgctcagctgaagctttcattgatatgagctctttcttgtgagcttgtaacatgagaacatttcaagctctttggcagtggttcaatgatttaacacattggcagaatttcatctaaattgtagatgtattcttaaccagtgcaatgtagtttgattagcgaaaatgaatggtattctctatgtctttgcaatgtgttttttgaatttacattgaaataaacaatcaaggatatcgttgtcatctctaacacctttatctgttgggctcataatcattgtttcttttttattattagtcctactgttgctctgtacagctgtcactgaaccatgcttcatttccttgtgctcttttatgttgtagaatatatgcaaagtagttggttaccagtcaccactaatggtgtgttctttgctttccagttccaccagcctactatgcccaccttgccgcattccgggcacgctactatgtggaaggagaaagctcagacggtggctcaacccctggcagcagcgggcagacagtagcccgggagggtcctgtggaggtgcgtcaacttccgaagatcaaggacaacgtgaaggacgttatgttctactgctga

SEQ ID NO: 817 - DNA, 9561 bp, Sorghum bicolor
gagatgaatagcaaggataaggatatagtattatagaagaaaatattaaggagtgagggtcgaaatgaagatttaaaataagcaacaatgtggagatgaatagaatatagaatatactatagaatgaataggatataagcctgggcaaattacccgatacccattacccatacccaaaatacccagacccagacccaaattacctgaacccgaggtacccaatcctaaattcggatagcgattttgattacctaaaattagcttgggtaattcgggtaatatcccccggtacccgaactacccgaattacccaaacatttgtctatgtctttgtatttatcatgtgttgttagttaaacattagaacttatcaatttattagaatataattctctttgtttgaacaagtgatcgtaatatattattctctataaaatgctattgaaattctaatactgctgaaattatatataaatttctactgaaattttgtgtagtgtgttgttttctgaaaattcgggtaaatcgggaatacccgaacccgaattatcgggtacccgaaattgcgggtagtgttttttttagactaatatcgggtaacaattttcattacacgaattttgaattaaccgaattacccgacccgaaaaaatcggataacccgaacgcctaggcttaaataggatatagtatagaagaaaataaggtagagatgaatatgatataggataagagtataggagaaaacatcaaccttagcaataggtgattaatatgttatagtatatatatagaagaaattacataaaggttatggaacaaggagtcaaggatgttgcaatggagatgaatagcatctatatatgcgtggaccacacctattattatcctacttacactttcgtcctcctttcgcataaaagagttaaccgtgagatgataggatggactaagccttatatgttgctttaacccattctaaccaaccaaggtaagactaaaccctctacaacatctcgttaacatgcacatgagttactatatgggccaaactccaaactgggccggtatgacatagcggtggcagcggtaggtagggtgggggggggtgagggtccttgagggattagggtttagatatgaaatatctataattagatttggatccaagggtcacaaattacgtggatttatacatggaaacttagttggtggtctcacgtttcctaggctaattgtacatagaagaagtatactcaatctcattgacaagtgggacccttccgcactctggccccacattcagcgagcttcggcaccgcccggacccgtaggtccgctccccgaaggatcaggtcgggagggctgcgtgcagccgcccggtcgtgtgcctgcccacccccacctttggctataaaacgtgccgcctggtcgtcttggtagtcagttactacttgctccttccacttcgccttccacctcgcaacgaaacgaaaccccatggcttcccgtgggcgcggtttcggcggagggcggcaaggccctggtggtgggcgcggcagcgagggcagggggcgcgggatcggtggcggcggaggttaccaacaaccctacggtcgcggcggtgatggaggcggtgaatccggaggccgaggcggcgtgggccgagggcgcggggtcggcggtcgcggcaacgggggaggccgcggacccggcggacgaggtggcgtcggctaccagcagccgccaccgccgccgctcgggaacgtagaggtcggaggccggggccgcggtggcgtggcggtagctgtaccagtaccagcccgccccgcggcgcctcgtcctcttgcgccggtcgtcgctgccccggcagttccagcagcggcctcgtcttctgcgccgccggcgcaagcgcctcgtgcccccgccggggcggctggaggcggagctgccttggcggcaggcatggggaggttggccgtggccgacaaccccgctcctcccgcgcctgctgcaggtagatccgaggcgcaaggtcctgcgcaccggcctccgcctccgcccctctcgagcaaggggatcactccgcctgcgcgccccgggttcggcacgttggggaggaagctcatcgttcgcgcaaaccacttcgctgtccaggttgccgacaacgacatctgccattatgacgtgagcttcatcccttcttcatcttctccttccttcttctcgtacttttgcactttgcggcgtccgcgattgctcgggatctgttatattcttttgatctgtacatcatctcagtgcttttcatttctctccctaccactaccatcatgtgccggtatgaggatcaccttgctcgtattagctgcggtttcctttctttttcgccttctattttcagggttttagctgcgcggtgattttgcaaaaagttaccatttcctggatctgttcgcgtggatctgctttagcagtgtaccgtgcgattctcgcgtactactagctagctgcttattccgatggatgatggtcgtgcagctttttccttcgcggaagtgttagctgtccgatttcctttcatttttttttctaggtatctaaagtagtagtacttttgcagttgctcctatcgagcaaatgtctacagcttgcgcgtgccgtacttgctgccttgttggtgtaaggagataggggtgaccggtcacacgtctacttgttctctatccaatgatagacagttatttctatgcgagggccaatggccagttcattgctgctttgccaatgatccattcataaagctttgttgttttcaccatttcctgatgaggtaaccaatggccagttcattactgctttgcagacagtttaggcaaggtctttagtactcttggtggttgcacggtggattcgtaatgatttcgccacagcctttttgatgtggattggacttgtggtggtgtgtgactgtttttgagacacatgcgtccagcaaccatggatgaatgtcagcgtgtttatcaaacaaaaagaaggaaacatagggattagtggatgacagcttgtgattctaaaattatttaattaccagacaacttgaacatgttcgaatcctgcatacctgatcagtagcactacacttctagcgcttgttgttgatatatagagatccatttgtttgccatcttgctcgattttgtcctgggttttgtttgctgaattctgtgtgatttatgtttcttatgtatacaagaaatatttgatatttctctcttaatgtctgattggaaggtgttttttttgtgtgtattccatacatatttgactcgacacatgcacattatcaggttttaatcaatcctgaaccaaaggcaagaagaaccaacagggtgattctgtcagagcttctcaaggtgcatggtgcgacatccctcgcccataagatacctgcctatgatggaagcaagagcctatacaccgcaggcgagctgccattcaaatcaatggagtttgttgtcaagttggggcgccgagaaatgtaagtaccactcctgtgtcatatgtgcagtacactctcttgtgacttgcagctgcttactgataaaatttgcatcctgttattttaattgctgaaattcagtgagtacaaggtgacaatccgatatgcggcacagccaaacctgtaccatcttcagcaattcctcaagggtcagcagagggacgccccatatgacacaattcaagcattggatgttgccctgagagagtctccttctctcaagtaggatatcagtgtcatttcttcactttcttttttttgcagtatcctttttgttgagctgctaaccacgtgcttactaatttccttttgttttgcagttatgtcactctttctcgatccttcttctccaagaagtttgataatggggtggacattggtggtgggctagagagctggagcggatattaccagagcttgcgcccaactcaaatgggcctctcattgaacattggtaagttatcttatccaaaaaaatcaatgtgtacaaaactgcaccaaataattacttgattttgattgagtctcaatattgaggggatggattgaacaaatctccacagtttcagtatgggaattttgtgtgtatgctattttgctggtgtgccattgttggttcgatatttatgtgtatgccactggaacttgcatctcaagttcagttggaacataaatatgaactgtgctgtttgctgtttggcttgatcgaaatagccacttgtttggcatacatttctgatttgttccaaaactcataagcctcatttggtacaactctggacggctcccgctccttcatgaacagccgttgaaaccactaagcttcactggttttggctcctcggtgcattgtaggaaggagttttgtggccctggagcgaaacacaaaatgaggcccctatatctagacaataaaggccttgtttagttcatccccaaaacccaaaacttttcaaaatttcccgtcacattgaatcttgcggcacatgcatggagcattaaatatagatgaaaataaaaactaattacatagtttgtctgtaaatcgcgagacgaatcttttaagactagttgctccatgattggacaatgtttgtcaaataaaaacgaaagtgctacagtgtcgttttccaaaattttttgaaactaaacaaggccaaaataccaaaattaggttccattatatgataggttacagttttcagtaataagaataagaattataatatgtatttaataaccttctccaccattcattaaaccactgggtaagagtgcacgaagttagatgaaaataagaattgagaaggcatgtcgctcgataagaaaagtaaaattaacaagcaggaaggacttaatggctgactggtggtaggctggtagctagaaggaacttgtcatggcaacctgccttgtcttgttaaatttcatggtgtggtatgcagtgcccgctgaaagacagtcaatgctaatatcaggtgcattgaattgtcgcatggaaggcaatatagtcatggtaggcgactcaagacttgagacataccaaaagagtcatataggttatcggtaaacgcttgcacaatgattcttgtgagctgcgtcaagaatttaaaaaagaaactgccaattaggctaactatgcttaaactaattaggcataatgacaaattactaattagggcctccggatttttgggggcccgctgtggtcgcgccactagcgctgcccaatatacctgcccaatacacggcctctttttttatgcgatgaatgtccatgtgtatatttttctgtttttaacctcttgaactcacttatgttgttcagatatatgctcgacttcattttaccaatctatccctgtggtaaaatttgttgatgattgtcttgggctgacaaaccctgcccaacctttttcggacagggatcgtttgaaggtagcatttgtcaacaaaagttgtcacatgcaatttaactacagtaaccgactgatctgtctctatctacaaattttcagcttaagaaagccctgcgtggagttcgtgttgagactacacaccagcaggggaaaaaaagcgcctacaagataactgggattactcctgttccattggctcagctgaggtacccatctgttcatatctcttccctccttgcctgtttgttctagtaccaagacgaacttatccatttccatttcttatcttcagcttttcttgtaacgaaggacctcagttgactgttgtccagtactttgctgaacggtacaactaccggttgcgctatactgcttggccctgccttcagtccggcaatgattctaagccgatatatttacctatggaggtaatatttgcatctttgtgattcctatacagcacctggtgcaccatgcaatagttacatgcataatatgtattttcaggtgtgccaaatcattgaaggacagaggtaccctaggaagctcagcgacacacaggtgaccaatatactgaaggcaacctgtaaacgtcctcaggagagggaggggagcattattcaggtataggccaatataactttggctttgacactgtcttttcgattggcaagtttcttagacatttaaatgtgtaacttcttgtactgatatttttcttttgaaatttaatagttttctctttcatctgatcttttgtttggttatcctgtaaatagatggttcaccgcaacaactattcagctgataagatggcacaggtgtttgggatcactgtggccaaccagatggctaatgtgcaagctcgtgttctgcctgcacctatggtatctattgtgcagcattctcaatttgatgatttatattttttttgattaattccaagactgacctatatatgtaaacttgtttcagctgaaatatcatgaatctggaagggagaaaacggttgcaccaagtttggggcaatggaatatgattaacaaggtgattctatatgctggctagttaaatttcctgatctgattttttttctattaagatcattttcattttagttgatataataggtacatttggtggttcgtagagttggttattgttggatttggagtagtcttcttcgaagagttggttattgttagatttggaatagtcttcctactgaggttcactttttgtttccagaaaatggtcaatggtggaactgttcacagctggacttgtttgagcttttcgcggattcagcttcatatagtagacagaatatgcgaggacttggctcagatgtgcaattccattggcatggtaaattcgtgcatatgcttctggatactattatagttaacaaagtcagcagccaggtaatgttgaatttgatgtcaatgatatttcaggattttaatccaaggcccgtgacagaagttcagtcagcctcacccaaccacatagaagctgctttaagggatgtgcacatgagggctccaaatttgcagctgcttattgtcgttcttccagatgtttctggtcattatggtacgtgcatctttgaaaaaactgtgcaacttataaattttgtgaaaataaaattacgtgcatattgatatgggagactttctttacacaattctatgggaaaagttaaccagtagcaagttatattgcttttgtgtagcacacatgaagaattattatgcacagcacacacaaggcatgttattcgcattgtatgtgtagcaaacgtgcagtgtactttttccagcagcacttatgcttggttttatggtaaagtcattggtatgcaaatttgtagggaaaattaagaggatatgcgagactgaccttggtatagtatctcagtgcatcaatccaaagaagaataaaaacaagcagtattttgaaaatgtcgcccttaaaatcaatgtgaaggtcagtgcagtttactgctttcttctctcttgtgtggttcagctgttatggaaattgaaatttattctgccttttatcaggtgggagggcgcaatacagtgcttgagagagcctttgtgcctaatggaataccttttgtctcagatgtgccaacaatcatttttggtgctgatgttacccatcctacagcaggagaagattcctcggcttctattgcagctgtctgtttcttgttctctgcatttgtttcgttcaaatgctatagtaacttgaacgaattttacacttcgcatttgaacatttactcccaatggaaatgttgtgacacaaagtaatggaatgatataaccttttgcaggtggttgcatccatggactggccacaagtcacaacatataaagcactagtctcggcgcaagcacatagggaagagattatacaaaatctgttctggactggtacagatccagagaagggcactccagtgaacggtggaatgataaggtaactttgtatcctttgtgttcatgagaactgttgaatgaaagaggtgacagtttgaaactaaggtgcggctgaattatgctctgcagggagttgctgacttcattctttaagaggactggacgaaagcccaaaaggattatattttacaggtatgtgcttgatttattacataactctttgatgaagccttcataacttccagtacttttgttttgtttatttagggatggtgtaagtgagggacaattcagccacgttttgctccatgaaatggacgcaatcaggaaggcctgtgcctctatggaagatggttatctaccaccagtgacattcgtggtggtacagaaaaggcaccacacaaggctcttccctgaagttcatggaaggagagatcttactgacaaaagcggaaacattcttcctggttagtaccatgatgttcatccttgttcataacttaagtaaaatagtaaacagggagaagaaacgtccaccttaagcattgagcattattagtgagaattggaccctggttgggttaaagacaaccgccagactagccatactatatcttagggatatctccgcttctaacataagtatgatattattttgagcacatacatgctgattgtgatttgtgtcttcttactgttaaaatacacaggaactgtggttgatactagcatttgtcatcccagcgagtttgatttctacctctgtagccatgctggaattaaggtatgattgagacacctgtcactcaggcatcaggttttttgattgtgtaatatttgtcactctgaatgtaaattcatttcttcagggaacaagcaggccaacacactatcatgtcctctatgatgagaaccgtttctcggctgatgctctgcagtttctcacaaacaacctttgctacacgtaagcttgacccgactcccattaaccactgctccaacttttgtgttactatatttgttccccaaccccaatatatttggtgccatctgaactcgagcacttttgttttgcaaatgcagatacgcacgctgcacacgcgctgtttctgttggtaagtcgaataatctgaccaatctgttcatgtgattagcccagtattgcaaattcattacttggggagattagttttctttccctgtttctctctgtatttgtgtccagattgatgatccttgagttcctccttcatgcagttccaccagcctactacgctcacctggcagcattccgcgcaaggtactatgacgaacaagagagcaccgatggaacctcagttgtcagtggtagcgccgccacagccggcggtggcccacctgcgttccgcaggctcccccagataaaggagaatgtgaaggaagtgatgttcttctgctgatgaaccggcgcgagctgctgtttgcttctattagtgtcgcatgcctttgctcctcagtatgcaagaggtgttgttagtttacaaacttagctgctgatgcaactttgagtatttgtggtgagttggtactgatggctgttctgactatattttgcatgagtgctgttaatgaattttagttgtggttt

SEQ ID NO: 818 - DNA, 7744 bp, Sorghum bicolor
ctggcatggagctaaggagcttcatgttaaggctttttctataatccatggaccatgctgggagattaaataaacaaacccaaaatagtatagacagacggtaaagtccatgtgaagaagtttcacctttggtacagcactgcattttgtggctttctattggggttttccccccgaatggaccacattgtggtagctgttttgccctccccaacaaaatgtgcatttgcactgtgtccactgtggtctcaaaagaaattgtaacagtgtcctgcagatcagcagatggggggccagctcacagtttagatacactgaaaaatccaaaaatttataaaattcttcaacacatcgaatttttcgatatatgcataaaatatttaatataaataaaaaaaataactaattatataatttatcaataaattgcaagacgagttttttaaacttaatagcccatgattacacaatatttgttaaatacaaacgaaaatactattatatcaaatttcaattttttttacatctaaacaaggctaccactgctgcgctagcatttcgagtgtgatgagacccatcttgagcgtagcatctagtctagtggtcgtagcagtaccagcagtagtcgcggattattctgcacttgttgtcattatccacgccttaaaaacattcctaacaccacggagcgagcggagctgcgtgcgatggagtgccgcacgctacgctatccgccaaccacacgaaggaaggaacatgcgccgtgcttttttcaataaaaatccccatccatccctcccctccatccccctggaaaacaccaacatccgaagcccagccgcgcccactgtctcgtgcgcgtgccccccagctcgttttccacggcttttttacgcgccgcgccatcacattcacctcaccgtggctgccgtgccagtgccacgccggcggcgtcgtagcgtgcgcgcactcgcgctagtgggagctcccagcacaatccccggttctccgacgcctgccccctttggtaaaaacaggaggattcaatcgcggccgctggcccgctgccgctacccttcgccggccccgttcccagtcaaacctgctctcgactccgggcagctgctgctgcatcagcagtgccgtgccgctggagagagagtgagagaggttctaatgcccttctgtcccgcgccgcattaatttcgcgtttttgagaggtccggtccggcggagtccggagaggacgcaacgcaaggccttttattttttaccgcgcgttttcacagtggcggcctctttctttcttggctcgtagctctcgttccgctcatcagcttctgcctgccttcgcctttgccgctttgctgctactccactgatcacgttataaggcttccgcgcaggcgagctgctgctgccgccttgtcgggtaacgaacgacctcacctcgtcggccgccctctccagtccagtggtcacatgctcgaggtcctggacatggcgccgccgccgccgccgccaccgccgcaggcgcaggcgcggcaccaccaccaccaccaccaggggccagccaacaagggcggcggccacgcggagcggacgaagcagccgctgcagagcagcgtgacgcagcccaaggcggagccaccggcggtggtggcggcggccgtgctgccggagggaggcaagcggtgcggaggaggaggaggagggaggcgccgcggcgggcgcggccgggccaaggcgccgccgggtgagtctcgtgctgcgctggcggtagcggtagcgccagcgccggcgcaggcgcctccgccgcgcacggtcattgggccgcccgtgccgagcaaggggctgtcgttctgccgccggccggggttcgggacggtgggtgcgcgctgcgtcgtcaaggctaaccacttcctcgccgagctcccggacaaggacctcacccagtatgatgtaagtgctctcgccgtcgccgctcgtttcgttaagcgctagcgcaattgagatcggaaggcgacgcctttgtgtttctccgtgtggttttgcaggtgaagatcacgccggaggtgagctcgcggaccgtgaaccgggccataatggcggagctggtccgcctctaccgcgcgtccgacctcggaatgcgactcccggcctacgacggccgcaagaatctctacaccgcgggcaccctcccgttcgactctcgcgagttcgtcgtgcgcctcaccgatgaggacgacggcaccggcgtgccgcctcggtacgtgcctgcgtttgttccttgcgccacttgggcagccgcgtccctcctcgtacgtctttcttaataatggcatgtcgtactgattcgcgagattgtgcgtccctccagggagagggagtacagggtcgccatcaagttcgccgcgcgcgccgacctccaccacctcaggcagttcatcgccgggcggcaggcggacgcgccccaggaggccctacaggtactcgacatcgtgctccgcgagctcgccaaccagaggtatttattccatcggcgcctgcattgattgcaacgccgcgcattgcccatttgcgttcttggatttgaggaagctaatgctagcgcttgcttcttccccgtttggttaggtacgtgtccatagggcggtccttctactcgccggacatcaggaggccgcagcggctaggcgacggcctgcagtcgtggtgtgggttctaccagagcatccggccgacacagatgggattgtcgcttaacatcggtgagttgtgctggctggggaatatttgttgccctcatgcatgtgatttcttttttgtcctgtggctgctgcttacacgacgatgttgacggcagacatgtcgtccacggcgttcattgaacccctgccggtgatcgagttcgtggcccagatattaggaaaggatgtcatatcaaggccattatccgatgctaaccgaatcaaggtaatattgctgtggttgggcaaggaatctactagcatagtactacactacagtgatatgtaacagctgcattgggtgctaacattacttatggactgttagctggttatgtcctatggtttttgtgcgctctaatccccaatttatctatgtaactcgcttattatgccaagcagatcaagaaggcattgcgaggagtaaaagttgaggtcactcaccgggggaatgtaaggcgcaagtatcgcatttctgggttgacaacgcaaccaactcatgaactgatgtatgtacagattctgaatgaactttgctagctcctgaactgaagtactgttattgtcatctctttcaatacatgatgatgtagcctgatttgataaacataaaagaatggtaacatgttgacacaaaaatcggttatacccaatttctgcttaaattaattatattgatttatctaattcgccttagcagtgaattgatttgtcaaaaaaaagttacgtgatgatgaagggttgttaaacattgatgcctaaatcatgcgatcatttttttctaattttgacagtttcccaattgatgagcaaatgaatatgaaatctgtcgtggagtacttcaaggaaatgtatggtttcaccattcagcatcctcatcttccctgccttcaggttgggaaccaaaagaaggcgaactatctaccgatggaggtcagtaatatgctaatcacaaacttatgtttgcctgtcaattgtgtttatgtttctagttagtgttctcaataatgaacgttgtaataatgagattttttaccaggcatgcaagatcgttgaaggccagagatacacgaagaggctgaatgaaaaacagatcacatcattgctgaaggttacatgccaaaggcctagagaacaggagatggatattctacaggttgagagtttttgtcatctcccctattattaaagaagtaacttttgaacacaaacacctgctgtatgttgagctagatgtactagggttttattgtaagtaaactgaatcatgtctcttgcactgaacatatgtattatatgtggagctaaatgttctagcattctagggtttttttttgttcccagtgaacaatctgaacattgcaagacatgcattataactgttcattgtcctatcctagagtcctgcatatatttgccagtggtccaagctttccatgcagtgggccttgaatagatagccattaacactgctagggtttttgttttaacaaaaaattttaacataaattttgattaaaatgtctcaagagacttcgtttattatttgttttcagacagttcatcaaaatggatatgagcaagatccatatgcaaaggaatttgggatcaacattagtgagaagctaacctctgttgaagctcgagtccttcctgcaccttgggtaagaataatcttatgtcactgttattcaattttctttcccttcggaagcaccttacactattattcatgaagttagttgctcactgttgatgcgttgaattacttttgtgaattcagttgaagtaccatgacactggaaaagagaaagagtgcttaccacaggttggtcaatggaacatggtaaacaaggtaagattccagcttgtgtgaatctattgtttgctgattactatgtttgattgcactaaaagtaggcctaattgcctaaaataaactcattttacagaaagtgataaatggatgcaaggtgagccattgggcgtgtataaacttctcaaggagtgttccagaaaacacagctaggggattttgccaggaattggcgcaaatgtgtcagatttcgggcatggtactatacccctcatctctgcatgtgtttatgcacaagacaaatacttgtttagattgaaactgtaagcatcttttaatttgacctcctaagtattacaggaatttaacagtgagccagtgatgccattatattcagctagaccagaccaagtagtgaaggcacttaaaaatgtgtataatattgcattgaacaaactcaagggtaaagaacttgaacttcttttggctatcctccctgacaacaatggtccgttatatggtaagtgtcataattgccttgcatatatatttactttttgaactcttacatattttctcagatataactttatatatattcaaagcgatataactttgtatttgtaggtgacatcaaacgtatttgtgaaactgatttgggattgataacacaatgttgcttgaccaaacatgtttttaagatcagcaagcagtacttggcaaatgtctcactgaaaattaatgttaaggtacttaccaccttgtttatacatgaaatacattgcagaacagcaactttaaaagataagtggctctattattgactaacggtaccattaaattcagatgggaggaagaaatactgtgctcctggatgcaataagttggaggattcctttggtcagtgacataccaactattatatttggtgcggatgtaacacatcctgaaactggggaggactcaagtccatcaattgctgccgtaaggctcattattactttgccattttctgtgtcaaaatgtcatattcatcaggatacacacatccttaccttggtttcggacttatctctctctttattttaatatgctgctcacaggttgttgcttctcaagattggccagaagttacaaagtatgctggattggtttgtgctcaggcacaccggcaagagctcattcaggacctttacaaaacatggcatgatcctcagagaggcactgtaacaggcggcatgatcaggtttttatctacgagaaatgtgaaatcctcaagcgcaatatataatttaatctattaaaaatattggctgatttgaacttattttctgtgatgttttgttgtgcagggagctcttaatatccttcaggaaggccactgggcagaagccattgagaataatattctacaggtatgtttgcaaatattgaccatcacctgtagcttgtagatggcaataataaaacatgtctgatgcctattattaccatgtgaatcttttctaaatacattagggtgtaggttggtgatgtatcgcagggtggacatatccattgctaggtcttctttatattgtaactaaattaccctttcctcgcaaaactaaattatgcacatgttaaatttattcaatttctctttcagggacggtgttagtgaaggccagttctaccaagttctcctttacgagttagatgccatccgtaaggttggttgcattttgttttattctattacactcttctaagctccttcttaaagtttactaactagtgctttccttcaggcatgtgcgtccctagaaccaaattaccagcctcctgtaacatttgtggtagttcaaaaacgtcatcatacaagactttttgcaaataatcacaaagacagaagtagcatggacaagagtggaaatattttgccaggtagtgtatctatggcctctaaatctttaggatgtgtatctataaccacactttcaactgacatattcctaagtttaatagtacttgaactaaaatgtattgtgttttggagtaaaaagtatcttgtctaaatttaagattttaagaaattagccactcttttgaggcagtcagatttttcttttgtttaaattgcatgatgttgaagttattcccttgtttctatgactgctcacaagttgattggaaacaggaaccgttgttgattctaagatatgccacccaacggagtttgatttctacctctgcagtcatgctggaattcaggtaagggcctgtttcggtcccatgaattgaaacaaatatctagatagtgcttcccatttcattattattaggttactttccaactgttaaattcctgggaaccaaacagggctagtattcctttgtgggatcctgggaaccaaacagcatatgttcctgtactgattttgtcatttgtgaaatactactagtattgaaaagtcttgtcatatgctctattccacaagctatttgcacctatctagtggcctccatatgctaaaagaatagtataacaaactgatcctatggtcaaccttttatcatgtgattgtacagctatggtacttggatcagtagcatgggaatatagtcagattctccgtactgtactgtactgaaatgactgatttgtgagtttgccagggaacaagtaggcctgctcactaccatgtcctctgggatgagaacaatttcacagcagacgaaatgcagacattgacaaacaacctttgctacacgtaatgcacttttatatgctatatttgtcccttgcattttgaactttaacctttcagaattttcttagcttgatgtacatgttattgatgcagttatgcccggtgcacacgctcggtttctgttggtatgttcttctgtgctttacagacaaactttttcctagttccacaattttaattatcgactctttatcctgctcacctgttcagaaaagaactttgacctgtgatgttgtatcttttgcttcttaacagtccctcctgcatactacgcacacctggcagcattccgggctcggttctacatggaaccagagatgtcagagaaccagacgtcaaagagctccaatagcacgaacggagtctcggtgaagcccctgcctgctgtgaaggagaaggtgaaaagggtgatgttctactgctga

SEQ ID NO: 819 - DNA, 17643 bp, Sorghum bicolor
tttaagacagacagaccagtactcctacttccgaaggagcacgagcgtggttgttgcccccaccacttcatgccttcgtcgtggtctcgtggaacattggaaattttgaaaggcagaaaaccaagcgcacaaaagggatcgaatctccaggcccacccaccgaccgttcccctcctgtcaagcgaccgaggtactgtgcccgacagctacaggatggggttatggggatcagaggatggcgcaacgcggcaatggaccctcgccgagtcggaaagcgtactcatcactaccgaacaagcgcaaaaagttccgtgtcccaacatctttcccctcccgaggccctgttcggtttttcaagaatcttggccacattaaggtcttgtttagatgcatccaaaaaaactcaaaactttataaaatttctcatcacattgaatcttacggcacatgtatgaaacattaaatataaataaaaaagataactaattgcacagtttacttgtaaatcacgaaacgaatcttttaagactagttactccatgattggacaatatttgtcaaataaaaacgtaagtgctacagtgttaaaatccaaaaagtttttggatctaaacaaggcctaaaccttgttgtatatgcataaaacattaaatataaattaaaaaataattaattataaagtttatttataatctataagacgaattttttaaatgtagttagtctataattggataacaatcgttaaatacaaacgaaaatgctataatatattttattaattttttcaccaaggccttgtttagttcacaaaaattttcagaattttccgtcatatcgaatctttgaacgcatgcatgaaccattaaacgtagacgaaaacaaaaactaactatacagtttacctatagacaataattgtcacatacaaacgaaagtgctacagtagacaaagccaaaatttttcacgaactgaacaaggcccaagtaaaaacatatttggttgcatatgttaaactttatcgtctgtcacatagaatatttagacacacacataaattattatatatattaattataaaattaaaaacatagttagagaataatttacaaaacgaatttttaaatataattaatttataattagacactaattattaattaaaacaaacatattatagtatcaattaaactttaacggccaaaactaaacatccctggacagtccccgagtctcaaaactctcaacacctccgtttcactgccaaactctcccgttctctcccaacagttcgttcccaccccgcacgcacgcgcgcgcgttgatttgaggcggcgcttgcactgcacggcgtcgtggaggcagcggcagcggcagcggcagcgcaaccgtccaccaccaagccctccgcattctctcgtgcacgcgtcgctaaacctccctcgccccttcccctgctccttctatatacctcgccgccgccgccgccgaagccgaagccgccggggaggtggtaatggcggaagaagatccgctgccgccctgcgacccgcagacgcaggcgagatggtgagtgcagcgccaccgcgcgcgcgcgcgcgcgccctgccgccgctcggcgatcggctcctcgtccgccgctcgctcgctcgctcgctcctccgtcccgctcccgtcctaatgtgggtgcccgccccccgcacgcaggtaccagctcgaggcgctggagcgcgcgctggccgggaacacgctggtgttcctcgagacgggcgccgggaagacgctcatcgcggtgctcctcctccgccgcttcgcgaaccgcatccgctcgtccccgccgccctgcttcgccgtcttcctcgtccccaccgtcgtgctcgtgtcccagcaggcgcgcgtcgtccgggcgcacacggacctcaccgtcgccgagttcttcggcgagatgggcgtcgacttctggaacgcggacaagtggcgcgacatggtcgacggggccgaggtgctcgtcatgacgccgcagatcctcctcgacaacctccgccacagcttcttcaggctccgggacatcccgctcctcatcttcgacgagtgccaccacgccaccgggaattcgccctacgcctgcatttttaaggtcaccccgaaagttggaaccacgcttggctatttttgtcccccaactgaccctcttgtctgttggcatgcacatttattgatctggtttccacatatcgcagttcagttacaaattttaaggcttaagtttgcccacgtgtatcagttcagtatgtttgtatgtgtattggggtaggagtacaatttttggtggaatcatgaatgctcttttttggggggtaaatttcggtttcagtttgtcttggattctttcctttttttagaatgtatatccaacaatctagttaaatcttttatgtgtctttttctggtaggagttttatcatccccaactgaattctaggccatcagatcctattccaaggatatttgggatgacagcttccctaattaattcgaaaggtaaggttggggacaatattatttgtatatttatacgcctttaattaattaattcaaaaggtaaggaggcggcaatattatctgtatatttatttatatgtgcatttcattctctcattaattaactccactctattgtggaattttgtccacagatcttgcgcgtgacaaatattcaatgaaaatatctgagctcgagaacctcatgaatgcgaaggtcaggctatataagaacacccacacaactgtatttcagataatcattattatccctaatttgtaacatgtgacaataacttatgcatttccctttataggtgtacactgttgccagcgaatcagagctattgcaatacattccatttgcgactacaaggataatcgagtatgatgattatatcgtaaagtctgagttatatagccatactatccgttgcttggacaaattggaagcgaaggtactattatatactctaggcatggtcttttgctggacacagattgattacgttactctgcatcacccagtatgtaatgcagggatcgttttctgtgcattctgcattatgatattgaagtatatcattgtagactgtagagttggaatcttatgatttaagatactaccattcccagcaaaattatccagtcttgtttttgtaaacacattttctgtttgatgctgaaattgttaagagtgctacaacactctgtaaacaacattagtttattctggttcttaattataaatggtaagcattattacaccttatatatctggttcacagtgtaaatggtatcgtgaataattcttgtaagaataactaagtatgactgctgaactcaaatagtttagcaggaagggtaacactacatactggtaaggtggtttaatattagagtgaagtccatttgaccccatgaacttgtcattgggttcaaaaaaccactctcaactcaaaaactagaaatccagacaaattaccccatatagcagttaaaagtgtttttgagttatgttgacatttttttattcaaaaacaaatctggaaaacactggataaggttcttaataaaccatgaaaaatgataaggatcttaagcctcttaaaaaacccaaaaagatcatagagatatattaggacaagatatttagagcttttgaatgtttaaacatattttgaaaactttccacacaaaaacatgagttgcaaccagctttaaatgaacacaactagcactattgcgtgttgcattcttgctaattgcatctcatatttttgttgtgaaaagttttcaaaatgtgtttatacatcgcttagattgttctgggaattttctcatttttattggatgttttccccattttactagagctcagtccaattttaaaagctttcaatttcactggctccaaatatttcatttggatgtatcttgtcataatatatcacttggatttttttcttggatgtttcggaggcttgaagatatttttcgtggtttaaaaccttatatagtgtttaccatatttgtttttattataaactaaaaaaggacgatgtggctgaaaatcaccctcaaaactacttttaactgatgtagaagtaatttgtccagttctgaaagttggaggatgtaagagttctgtttttagttcaggtgttctttttttttttcagattcaacaagtttatggggtcgaatggactaaactctaaatattttttaaaaacactaaactctaaatattacaggcataatgctcttcgaaagaaatctgattatgttagaaatattcaaagtaatactcaaccttgaaggggtgttgaacaaatctgtattattcttttgttttgttataaatgtgcaactgtgccacaatcacaatgttaccatggctccatatttatattccaaaaaatgcagtagttgtactgatatccatattgctttctttatctagttttatgctcacaatggtgcaatgcagctttttagtacattttagtaacttctttcatcatgttctgagttgatatgcatatgaaataacagtggttgcattatcttagcatttagaaatcctgaagggcaaactgcatggttcatatttggaaaatgcagagaaaaggattaaaaaattaaatgcaatgttcttatattgcatatctgatcttggagtatggctggcagcaaaggtacgaggttatgtaatgtgcacatttttatcattcttatgcactcctaaaaatgctttaaaaccttttctcaggctgctgagattctacaatcaaacaaggaaagctgcgtatccttttggggtgaaaaactggatgacgaagttgagggattcattagaaactatattggtgacgtaaataatgaactgtcagaaattatattgaagatgacaaagaggggtttacaacgtaattgcatccttcttcctttcttgtttcttcaatgcacctcttcctaaaagttttcacttaatataaattactctgtgcaagttttctgccaatgctattcagtattttttactcagtgctgataagacttttcgtatctataacaactaaggtgtatgccaatagtaatcactttatctatccattaaataaaatactagactcaaccacggggagaagatggcacttcccccaacctttaggcaggggcacacgacctatgaacacctggggtttgaagtttgaactggggtgggcagcctctcaactgaaggctatttgtcgatttgacaatttgcattattagagatgcatttggccttagcgtgtgtttgaattataacactatcaaaaaatgtatgtggtgcggtttatttttgcattcttccaaactagattttgactattgttttcttacataagaatattgtttatagatatgtatgactctatttattttttcttctattaatacaatgatacgcagctctcctgcgtgttcgagaaaaaaaattgtttatagctacaaaatcaatatagtgcaaaagcattttttttgaatctatttatatgatatttataccaaacgtaccttgactaaatattggtcaaaataaacagtttgaatcttcttatagcatgcaaaccctacctgattatgtatgatctcatatttaatctgtctatacagggcatattggtgaggactttgatgcggatttgcaagatgggttattgaaatccaaagtttattttcttatcaaatctcttttggagtataggtgagaaaatgcttggatcttaagtatgtatagtttactctcattgcctttgaagtagtgatttgactacaacacatgtctaaattatctcgacacccaaatcctaaaccacagtgctcaccataccttcaaatctaattcagctaaagttgcctattcaaataaatgtacgctagcttatcctattgatctggtatagttttatgaactgaatggctagctggatgattactgccttgcacatatcttgatgtcatcatggtccatgcactgcggctctgcatatggccatatggtataaattgctaatgaaatgatacggccagctgcaaattattctctcttgttgtaaaccatgaatgattaatctcctgctccctcttgcaggcatgtgcaagatttgagatgcattgtttttgttaagagagttattacaagcattgtgttggaggctcttctgtcaactattaatcaaatgtctggatggagtgtaagatacatggcagggaaaaattttggtttgcaatatcagagtaggaatacgcatgtggaaattgttgattcatttcgaagtggaaaggtttgccactaatgttgccctgcagtggtcatgtcttattaataattgtactgatgataaaatgatatcctgtaggtgcacctaattattgccacacaaattttggaggagggactggatgtgcccagttgtaacttgataatccgctttgatcaggcagcaactgtatgcagctttatacaatcacggggtcgagctaggatgcaaaattctcactatgttttacttattagaaggcatgttttccagttttgtagctgttgtttcgtgagcaatttttttttgtactttcagcttcatgaatttcttttgggtccacagtagactttgtaggatcacacttttggtcactcaccgtggacacttggtccttttgttgagtagaatgtggatggtggttgtctttttgatggcgtccgtgacacgtctgttttctgtttcgacgggtgtgtttgggtttgtttgggagcagactccagcctttcctttgtacttggagtaggcacttgcttctccttgtgccttttctccttaatttttttcgagaacgtgcgctgcatgtatttcattaagcagagaaatagagttcacaacccaaacaacacccggtaatccagagattaccgcagaaacttggacccaaactcacacgctagccttttctccttaatgaaatgacatgcatatctcttgcattgtaacagaaaaaaagtagactttgtcagatggattccccaatcaccaattgaattgcatgtatgggataaagaacatgtagtttgttgcatttttttagtgtaggcacaacatttcctgttgaattgtatgttgtgaattgctaagtgcacatttagtctcagtggattaatctgcatgccagtgcaactgatggtgatacgagaaacaacgtgaaggaccaacattagaaaaaaaacctgtgttttgttcatggtggtactgtcttcatatgtttacaatcgttagagatttgagatattgttcatggtggttctgttgatttactatattcagttaaggaccctgtaatctcacatttgttgtcaacattgtggttcaacttatttgagtgatattgttggattttgcatattgctttacatgatcattgagttttttctatgcttctgtatcaggggggacgccaatgctctttctaagacagaggagtttctcgaaagtggacaaatcatgcgtgaagaatctcagagattggaatctactttttatcagcctcttccaaacaccctatgcaatgaagaattttatggtgttcaatctactggagcaattgttactctgaactctagtgttcagttgatttactttttctgctcaaagctaccttccgatgagtctgttttctttcttagattagacaatgttttcttttggttcatacaacaaaacatttcctggtgcaaatactaacagtttttatcaacatatgccaggtattttaatcctctaccaagattcaatattgacaaggcattaggtacatgtacgctgcatcttccaatgagcagtcccgtacaaacaatttatgctgaaggagaaatttctatcatcaagagggttgtttgtcttaacgcctgtcgtgaattacatgctgttggtgctctcacagattatctcttacccgaatcgagtgttccatgcgaagatgaacctgacattggtattcctatttatttgttataacaaaaaaatgaatcaagacttcatttaattgcagttattatttttttttcattgtgactgcttacatacgttggataccatttccttcagtaatgatatacttgcagttttatctgagttatatttgtactatccaaagcttctaaactcaacatacatatcttaggactttgggcaattgtggagggtgggatcacacatagggcacgactacagtgagtggtgtagggcagggagtggtatggctttagagagactattattttagctaaggtcatctgatgcttacaacagcaaaatggcttatagtgggtatgctggattcagaggaaacttcattttgtaggttcagcatagaatgtttgatcggttatgaatttccacatttatcaatgtaactgttaagtttcaattgcaatgtaggggtgagtgattagaaatatcaagttttgtgtatggctaggatccaaacagtaccattttcttgtcgggaattttcatccctgcctgaaatgtgtatgctagaaagtcaaaagtgtgcacactcgtttgatccatgttttcagttgggtaatcagtttgacatgcaattgaatcggtatattatactaagactgtattaactctggtgatgtagttgtggacaaatacaaggaggagcaacctgactactttccagaacaattaatggataattggttgtctttttgtcatcgtggcttatattattgctacaagatctcactggaaggttgttctgaaacaactactccagctgagatagtattagctgtaaagtgtgatttgggatctgacttcatttcaaccacattcaaattgtggggtgtgcaagactatttgagttttaccataagatatgttggtgtgattcatctaaatcaagaacaggtagctattctcttcatataatcttgttctgtagtcaccataccatcctttctttttctcttccatagatgaaagtattttgggcccttcattatgaatacacctctcctgctcaggtaattgtcgccagaagatttcagacaagaattctttctttgcttattagtaaggacctttccgaagacggcaattctattaagagtttacttgaaatgcaagtatcttctggagctgtgtatctacttctgcctgtagtttctggaaaaattgattggtgcagcatcaaattctcatcctcagaaatgcatgaagatactatcatggatagtagacacagccattcttgtaaagatactggtttgctgcagacaaaaggtggccctttctgcccatgcatgcttcaaaattctattgtctccaccccacataatggcatgctctatgctgtttctgggcttcttcttgacttgaatgctaattcgcctatgcgtgagagtgttcttagctacaaaacccattttaaagaaaggtataagttttgtctttcctttggtattctttatgtcatgctcccataagctgtagaaataatctttatgtatcttatttcttgttttacattttccagtcatggccttgacttaaaatgtgaagatcaacctctcttgcgtgccagtaaacttgtgaaagtgcggaacatcctccatgagcgcaactataaaaaagaaaaaggttcctttcttttgagaagagtatttaaggcatatccatcgggctgcatattataccatgtgctgtatcaattagtttgcgctcaaattctgggagatggaaagactgaaaacatgggcttgtgattttcctaactgttttctcttagacgtgagcctcacatttgcaaaagctagcataattgacttgtgggacatgggtccatgagtacataatgatcttttgggcgcatgttgattgtctggcaacattggctacacgatagaagatgaaagagtttcaagtgttaaaaagatttcctttttttttctgtcttatatctatgttcttaatactgagtttatctgtggttactaacaaaactacatatttaattagtggatttacattgtaaatatgagtatgagagtatagaacaaaacctttttgtcacaggcagtggcggagcttggacctaaatccagcaggggccactaattaaagaataaggctaatctttagttttgttcaagccaaatggatgcaattatatggattttacataagttcaggggtggccatggcccctattggtctatgagaagcctcgccactggtcacgggtgcacatgtaccaaggagtaagggtttgggtgttatagtgtactcagggtttctactgttctctcttctctctaatacaaagatagacagctctcctgcatagtcaagagaaaaaaatacactgacatcttatagctgtttcagttatggatatgtgtcatatgaattaaactcacttctcctttttgaaaacatttttttcagcaatgaatattctactatataggtcttaataaaactatagttgattggttacttatgagacaggataaatgccacacatttcagctttaagttctcttagaagcttctagaattcaattcaatatcacaatggttgtataggtagacagttctatagcagaacttgtttaatgtgtacatgtatatttcaagtaactgtagtagtttggaggctcgaatttgtggaaactacattttttttgtcttcattagtgcattatatatattttaaattcatcgatggtttgctcataggtaccatttgtgtacaaaatttcaagaaactacatttgtctcctctcaagattatataaactgatcaaagaataaaggagatatgccaatttcatgtcctttttctactgagcatagcttagcaagcttcttagagtaagggagtcagaagcttcatacttgcagaaaggcctaatacctgtttgtttgcctctctgtttttgaggggtggtttttggctgacctgataagttggcagtcttttttttttttttggggggggggggggactttttgactgaattctaattgtgggccagaatatctctaatatcctctactaaaaaattggatggttcaatttatatacaattttaaattgagttttttatactactataattaaataacttgtttgttaaatgactgattccattatcctgtttcagaaagtacaaatgtgtttgaattgccacccgagctctgcatagttgtcatggcgccagtgtcagcaaataccctgcgctgcttcacatttattccttctataatgtatcgtatccaatgtatgcttctttctgtgaatttgaaaacgcaattgggtccaagcatgaagcagttcgatattccagcactaaaggttaaattcgatagcagtttttctactttatgcacatccataatgttttagaaaatgtagctgctaaatcagcttgttgttctctagatgcgagaacagagctattggtttcccatatacactgttttattagtctattgctttgttaaaataaagattctgttcagttattcttcagttattgcatcatgtgcatcggttcttgtcataatttttcttctccgaaacaacttgtcattatgtttcattcccttgggatgatttttctatgagtgcttccattagttcagatcctgactctgcaaataggagctagaaatttattgttacttaaatataattttacattatataaaagtattttcatgacaaacctaggaatgtcgaccttatcaagtcaatctatatgattatttagctattgatggttgaatctaaaaagtttttgacataagagataagagtttataagacgttttgacttttctagattataagacgttttgacttttctagatacattgcttttactatgtttttagactatgtatatctaagtgaatagaaaaatgtatctagaaaagccaaaacgtcttgtaatttgcaatggagggagtacttatttgggatcagagtatcttaaactgatcaagatgcaggatatgcatgctgcttcatattctcttcagaaattttcagtgaaattatttgttgtcaccagcgtgaatattcttctatgcacattgtctgtacaagggttctcttttttttactcattcaatggcttgcaggttctggaagcactaacagcaaagaaatgcaaagaagaattttcgcaggaatcattagaaacacttggagattctttcctcaagtatattacaactcagcacctctttagcaaatacaaacatcagcatgaaggcatgctaaccaagatgaagaaaaacttgatctcgaatgctgctttatgccagctggcctgcagtaacaatcttgtggtactctttcttaatctgatatttttttcttgtttggaatataaggtcctctttgtttacatgagttggtcctagaatcgtcgatttgaaaaatggaattttctgaatacagctgtttggatcagcttagaactttaattagaaatggagtctgattgtatcacttgagagcaactcccaataccaagctctaaccttctgaatagcactgaccacagctcatcaactccacctagtctctccatgtacaaccagacaccagacaacttccatctccagtgagcttgtagagaattagggaaacacctcacacccaattagagctccagcagtctggccttaagccaatgctggtgaaattgctagtgaaaaactagacctgcgggggtgtgtaagacagccctcgggcattttgctaagaagaaacccccgaacccctaccccacccatacatagcggcaccgtagcccatgtgagaactaccacaatcagggccggaccttatacctgtactttagcgtggggtgggactgacgggaggattttttaaccctagcctaaaatttgctcccacggggagtcaaaccaagggtctgaggagtgctaatcaagtcacctaaccaactcagctcagctagaggccctttcgcggtgaaattgctagtgacatccactttatttgcctctgacaactttctccttcctcttcgagcacacactggtccatatccaatcaatgccaccactggccattgcttcgtccttttcactggcagtgaggcccacactgctgttgttgactggaattttccagggcctgggctttcgctgctgttgtcaattgtggaatattattcctcctttggcgctcagaccaggcaaaggtgtgagcgtgtggcttggggcctgggatcatggagctggccattcttcctggcagacagacttagattgtgttagaataggcgccctttgggctgttatcggcctaatgccttagtggttaagttagattgataaggcaaggatcaccgttatctgggtgtttctataaacccttaggggatccttgcctatatatgtactctgtactcttgattatcaatctactaatctcgagacctattggctctcagattgcaaaactttggtgacttagatttcacagctttggtgtcgttgctcatgtatgtaagcatgggcgcatctttgatgcccttgcctgcggtactgctgctcccatacagcattgggtcatgtgcattgaggtctttggctctgagcatggacaaaaacagtatggcctcatggcttgtcaagcgcacatctggtcgcccaactgcaccagatcccaagccttcacatcctgcaaggctcatttttcatgccgtctttcgaatgaaacagtgtatggaatggattttattcagcgatttcctctataaccagacagaagaattgaattcaagcctgttttcatttcctcctatattcaatttggagcctcatttgaattcatccaatccaattcaacaaattgagcctaatacttttttagtgtgttaggtttttgttgataatcattgaccccaggtcctcctcctgtatccgttatccaaatattccttctaatcaaaattgtttaaaacactgacatggtccctaaagttgactcctttttgcacatttgaggtgtctataagtttcaaagtttttgcatgcatgtatacataaaaatctttttggcaactccatacacaatcgccattgacaacgacatgcttaccagtagcctggtgatcagtaaagagctgattgaaatattaaaatctgtttagataattctttaccaatcagccactaacacaatgtgtctcagtgttctctgttaaaacttggttgtatcatttatttgcattttcttgttgtacagtgtgtttatctgtaccatttctgcatttgttgtgcctttttctttgattgcagggatacattcgaagcgaaactttcaaccctgaaacgtggattattccaggggttggcaatgactcatgtggtaggagtctgaggaagcttaaaagtaagaggatcgcagattcagttgaagccttaattggggcatatcttagtgctgctggtgagcaggcagcgtatcttttcttaaaatctttaggaatggatatagagtttcacaaaatgccagttgaaaggaaaattacaatcaatgcggagaacttcattaaccttagaagtttggagctaatgcttgactataatttcagtgatccatcattgttgttggaagcactgacacatggttcatatcagattgccggcactactgcatgttatcaggttggtctagaagccaccaaacacctctctgtttcagattagttaatttctatctattttcccaaagatccctgtctacttcagcgtagaggcttacatccagtattatcacagttgggagtatctttatcattaataattaccttgcattctattattcacttacaagttacaacctagtttcatgagatgaaaatcacagtgttgtggggtaccccaacctctaggccattgagaatacaaatattctattggtatatatatgggtgatttgttaaaagcattattgtcttcagggggagtctaccaaatgcccctggattttatcatgtgtcttggggcaggatgggactcctctagcacccaagctccttcattttatccacgagggcaagagcaccattgcttgttcagtctcttcacttgtaacttaattcccctctctagttcgtgtagtttaaagggtagggtacaaccctctgtttgacctgtaaggacagcacagaaagcataatcaaggaagttttgcaagatagtttacttaggctagaaagataattcatagcctcctaacagtggatggaaaacaccaacaaacttgaactatatgttctgtgtattctaagaggactagtaaaaacaagctgaaagcacgaggtaatgaaatacactattgtggatctcaatacgatgctcaagttgaattatgttgaatcctttgtggatgatgtaatattttagggtatctaaactgctgtaaaaaaatgtggagtatgtggtttacacatggtaaagtttttcatctttgagcataacatctgtaatgggagtgcatcctgcgcatagttctgctgactaaatataatgggagaatacttcatgggagcaccaaatttataaaaaaaaaccaatatttgtgtcaccaaataattatcattaggttcatcattagatatgttttcatagtatacttatttggtggcataaatgttaacaatcttctctataagcttggttaaacttaagctagtttggcaagctatagtgacatgttttttggggacagaaataatactacattggatgaggtgaataataatcttttgtattaaatgaatgcacagggcatcttttgttggcacagttcaatttgtttcttgcaaaagagtatctcaaagatactgttttattgtttcctatatttccacagaaaaagaatattcctcttagtgtgttctatcatccataataaatttgatactatcaaagtttataccaagcagcaggtaaccattatattgagttacttacagcttcatgcatttatgcagcggctcgagtttcttggagatgctgtattagatcatatttttaccgattatttctaccatcagtaccctgaatgcactccagaactgttgacagatctgagatctgcttctgtgaacaatagctgctatgctcatgcagcagttaaagcaggattacataaacatattctacattcatcatctgcactgcacaaaaagatggctgactacctcgacaagtttgagcagtcattttcaggtccatcacatggttgggaagctggcatctgtttaccaaaggtgcgtcttatttccttctaggtgctaatggtctaatattgtgcaacttttagcacactaatagtgcattttcagtgctctggtgccatgtttgggaggaaaacctggcctctagcctgagtggcagtaaccacctagactccctcagttatagattcttttcagctttgactaaatcctttcagaacaggctgaaacactaacgattaaatggttagttctttacaggactaccaactaaatcatatcattaaccaggaaacaattttggttataacaaaacagctaacaagtaggggctgttagtgccatagtggctcatgtagacctgctttgtgagtgagggtacgtgtgctaacttcatcccaaacctcgtgcacgaccaaggttaaactagggacggcactgttaaaacaatgtcggccagcaacattgcaagataacaagcaagttgaaaccctttcgtccagctttttaacacgtcaggtagccttccgccaccaggtctacttctcatctggttgtggagcgacacatctgacctaggcaatcttttgactatgttttgtgttcattctaaagctgattaccccaactaaaaagaatattttgtttcttgagaagcctttgatccaaacaaacataaataaaaaatatgccctaacatagtagaacacactgttgcatgttctccataggttgagggtaataaatgttaaaccacaaggtaacatggggcaaatattgattaatgacacccatcgtatttcctttttggaggaacatagtaaatttcaagtactctgggaccctaatcgtttgcttatttgcatacatgcaggttctaggtgacgtaattgagtctatcgctggtgcaatctacattgataccaagaacgacaaaaaggttgtttggagaaagatgaaacggctactagaacctcttgccacccccgacactcttgaaattgatcctgtcaaagagctgcatgaattctgtgatcctaaaacgtgcagtatcaagtacacagtagctcgtgaggaccgggtaacctcggtggccgtagaagtacagaccaaagggactacatacaaggccactcggacaggcctcaccaagcgtgacgccaaaaagttagcagccaaatccgtgctcaaagatatgaaggccgcgaatagcacgcagcattttgcaaatggtatcagctgcacttaa

SEQ ID NO: 820 - DNA, 7985 bp, Sorghum bicolor
aggtggtggagccgccggagtccctgtacaccgcctggatcaccggcgagcggcccctgccgccacgtccgcgacggcgatcctgatccggcgaccgcgactgcctgcgcatccggtccgggctcctccgaagtggacggcggcgatcgcgcggctcctcgcgcagatcctggtgcggctcctcctcctcaaacggctgctcatcccagagctctcgacgcagagcggcggccgtggtagcggcctccctggctgcggctgctgcggcctccgcggcttgctgcgcttgcgcggctgcggcctctgccgctgccagacgctgcgcgcgctgcccggcggctgctgctgcagcggcggctgctctctctgcggaggtggccatctcacaggatcaagaacacgctctgataccaattgttggataatttggtgaacacgagattgatctggcaacagccagagggcagtttgcctgctatggccttttgattgaattgcaaaaaatggatctcggttacaaaaccccttgccctgtctccagctcttataggctgagggctgcctcttggataggcatattctagagtagattcctagttaacttggctgccaagggtcttatcttcttgacccccaagcaagcctattacagccacataattaaaacagagaaggaaaacaaaactgcagtgggcaatacttaggccctgctatactagatacatgaccaactgccatcaatttttgccccccccccccccacccccacccccatgccccaaaaaaaaagaaaaagggaagactgcaaaaggggcaaacaatggcatctacagcagtgacagttaaaactgttacctgtacccagtactctcttagttagatatgaacgatactttcattagtgtgcagagtccagacggcaacattagcgactcaaagctgtgtgtggctgaggagatacataagtgctaaaacgtacagttgccagacagaagtatattaacagacgttagatgaccacttctgtgggtatgagcctaatagggttttcctctcagatctaaatgagcaatatcataattaccttatgattattggtgtcgggaccaaccaaatttggtattgccactaacaggtaactgagcaagtcctagtatcaaaagatctcatccatttgattgacacccatggatggctgtggcttatgcagtaccaagcaaactataacttgtctagttatacatatattggagagaagttcgttcaaccacttgttttattttattttactttcaactcaattcaactgtaaattttaatcagattcatgaactgcatgttaatgtatttgatctggtattttgctacttcctgcttttatggattttaagcactgagatgattgctgtgattctttgatggttctgatccttgtacagtacttttgatattatgttttttcttcactgcttcttataagaatctgagggtcgtgaattgatggagcactttgtggagttacctccagaactatgctctttgaagataactgggttctcaaaagatatgggtagttctttgtccttgctaccatctttaatgtgtcgcttggagaatttgttggtggctattgagttgaagaatgtcatgtcatcctatttcccagaggcttctcaaattagtgcctcgggtgtaagtaatactaactttcgcactgttgagccggaaacttctaatttcattttgttatctatgctgaagtaattgtgatttacgacattcattacagatccttgaagcactgactactgaaaggtgtttagagaggatctctttggagagattagaagtcctaggtgatgctttcttgaagtatgtagttgggcgccataactttatttcatatgaaggacttgatgaaggtcagttgaccaggagacgttctgatatagtgagtaattcaaatttatacgagttgtcaattagaagaaatttgcaggtgagttgattgtatcaatgatcccaatatttattttatgctaagttttatatagttatagcagttatttcatcctatcttattgtagaagagatccaatgtgcttgtccttgtgctgacatggttacatggtttgagtggttgaacctcaagcacaagatggcaaaaaagtttaaatcatgatttttttttcctggctatttatagacagacccacattgtgacttgagacttagtgttgcatttttttaacatgcaggagtacaatatcaaatatcccatgcaaaacaagttagggcatatgccgcagtggttgagaaagaaaacagacaaaaaaaaggccttaaagcgctttgtgtgtcctactaatagccatgctggagctcctttttaagaaccacaaaaaacaccaaccctgttcacatctagagaagcaccatagtaggctcctttgttgcagtatttccgtaactcccaagcaaccagaataaccaaggaattagatacctttttaagttgcttgttggcctgtttaatagcttggctccacaagggaaaagccctattgtgtcagcctgcagtgcccaccatacgcaagcccgtagatcacacaagaatcaggaggggctgcatcgtttcaggagcttgattacacagaaggcagtggttatttatctagcctatcagtggtccagcatcggttaacaattgccgatcacatgaaaaacttacaaagcagtggtgcccatgatttccaaatgcgttccaaaggcacaattacattcatatggcactatattcaagcaatagcctaggctcctcggctgttggtacataggcttgggctgctagggtgcaaaattaggcattgtaacttgattctgacttcttttgatggcatgatcgcacccagaagccacaatgtggctccacccctgcatcgaaaaccccccttgtccacccctgtgcaacttagctttgatgtgaatttgattctttcttaattaccatccatttctgttgaacacatttgtttctgtttctgatctattttatcatgtttcttgtttacattatggttattggccttcaagaagtttaagtagagaatcatgactcctgtactttgtgcacatgttttccctttatcacctcaggtgagaataatttgttgctcgctgtgttacacaaaattaaaacatcttgatgcaaaatataggtatacatacgggatcaacactttgaacctactcagttctttgcattgggaagaccttgtaaagttgtttgcaatcctgacagagaagcaactttacacccgaagaatatcgacccagatagacgtgaaaactgtaacttgaggtgtacaaaatcacatcattggttgcataggaagacaattgcagatgttgttgagtcacttcttggagcttttcttgtcgagtgtggattcaaagctgcatttgcattcctacgttggattgggataaaagttgatttcgaaaattcagctctctatagagtattagatgcaagctccaccaatttgtctctcatgaattacatgaacatttctgagcttgaagaattgattggctacaccttcaagcacaagggtcttcttctccaagcatttgtacacccttcattcaataagcattctggaggatgctaccaggtccgaccttcctttttccctttttatctaattgctagtgaactattctgatagtaaagaacactcacttcagcatattctgtacatttttaatcagaggatggagtttcttggagacgctgttttggattatttgatggcctcgtacctctactcagcttaccctgatctcaagcctggtcaactaacagatctgaaatcattagctttgaataataattcatttgcttatgtggccgttaagaaatctatccataaatatctcataaaggattctaaatctcttacggcagcgataaataaatttcagaattatgttaatctttccagttcagagaaagacttgttagaagaaccaacttgtccaaaggtatgtgctttccttgattctttttacttgctgcaaaaacttcagttatctttctatagaatttgtgaatcacctctttctcagtgtatttttcctacatttctttgctaacacttcttttattttctttgagttgaaacaaaaagtcacaattagtaattactgctaaaggagcttcttgaattttctatattccctctggttctaaatgtaagttgttgaggacaatgacagtctccaactattagacatattaggcaggtctatgcgtgattagctataattagcacctgctatgtacacttgattgtattccttgtatacccagccatattggctatatatatgaaggtcacccaccccccaccccccatattgcgtgtgaggtgtgtctttacatggtatcagcctatcagatcgtagttttctgcacttcccttccacacgcggcctcttcctgaccgcgctgcagccaccacgcgcgcgtctccctcgcgcccgtccaccctcaccggctgctcctcctctcctctccaatggacacatcgggctccctcacctcggcctcctccccggccaccggtgccggcaccctgccggcaacttccagcatgccctccatcggtgctgccccgttgggtgccatggccgccggcgctgctgcaccaatcgtggctcaccactacgccacagtaaatgtcaagtcccacatcccgattacgttggaccttcactccaactactccaagtgggcgttcttcttcaagtcgctgtgcggcaagttcggccttcgctcgtacatcgacggctctgctccccctcgacctgatgatcctcagtgggatgccacggagtgctgcgtccagggctggatctcaggctccgttgatgactccgtcctcgacctcgccatgaatgacgcagatccaaccgcccgcgatctgtgggtggccattgaggggatcttccgcgccaaccgggcaccaatgacactttgacttcctatttttttataaagttataaaagtatttttcatgatgaatctagcagcatcaaccatatattgccaacctatgtaaatatgttgatgggtcaagtcaaagtttgaccagctagaatcctaaaatagcccgcatttgggactgagggaatacaagattagagagtggaatttgaggtatagctattgcaagataaacatgtatttggaatcctagatcattcaagtataggattaattcaaaaacttctgttcagcctatgtaatacattaggaactcctttttgaaaatagattttctgaatgaatcatgtagtttattggagacaccttggtattttgtttttaatcaaagcttgcatgcttttgctgtaaccatgcaggttcttggtgatattgttgaatcttgtgttggtgcggtgcttttagattccggcttcaacctgaaccatgtttggaagctaatgctaatgcttctaaagccaatattgagcttctgtggcatgcacatcgatcctatgagagaactcagagaaatttgtcaatataatggttttgagttaggacttcccaaacctacggaggacaatggagagttccatgtcaaagtagaagttaacatagatggcaagatgataagctgtactgcagcaaaccggaattcgaaagatgctagaaaggtggctgcacaagaagcacttttgaaactgaaggtatatttgttttggcaatatgttatgaaatggaaattgcatgtttctctagcaccatagttttcatactcttgattttttttattaattacttagaaggcatggcaaaatcatcttatttgtggcaataatgcaaccttgcatgtttacatagaataatggatacaagcataaaagaaagtcactggaggaaattttgcgtgctaccacgaaaaaagaatcagagctgataggctatgatgaagaaccaatcaatgttgaggatgacatacaaatgaagaatctattgataaatggagaaatggaaggaaacatcttttttcaaaataaagaagtgtctttgaacgggaggtctgaaacctccattcagagtacaacaggagataacaaggttgacaagaatgatgctaataatggaaggaacaataagtccaatgtggtcgtgcagaatggttgtctacctagaggggcaactgataaaacaaaccaaagagagtatcatggtatggttctaaactccattttttctctctgtaaaatatgcttgtcatctaaagcttggaaatgaagcatgcaaggtgtcaactacagattccaaccagccagatgaacatgtgaagcccttaattacatttataaatctacagtagccgttggtagtggatcctttattggtctttttaatattcttatggcatctagatgcctgtggtgcttgtcaaactacgcatagacctgtgatacacacttaggataggaaatatgctacaaaaaggttctgcatggaaaaggggcaattgcatacaacctgggtgcttggctgataagccatcactgaaaatactgtgcgctgattgaaaaacactgccgaatggctggcagattcgcagataagctcaaatgaacaagctcaacaccatagtgtatacttaggccctgtttagttccccatagagtacaaaatgcaaaatggcaactactttggaatgatgaaatataaaatgccaaaattttcagggttatgtttagtttcatccaaaatgccaaagtttttagggttaggtgggggtagtgaaggctctttgggtttttttttgccctcttgaggccaaaatccaaaatgacaaccattttgctaaaaattttggatggtgcttagttctattcagcaaaatggtgagccaaaacccaaaattttttggctcaaatgaggaactaaacaggccatatattgcctagaacataactagtatccataaagtgtgcactttattttaaaaacatttttgaatgaaaagttacaaaatttatgactaaactatacaataaaacatgtttggcggttatgttttgcacgtgaaatgtgaccatattgtgattttgatcaattttggaggtaatatctttataatattgtttagtactcctaccttgacaggtgacatggtacgcaaaacagcaaggtcattcctttatgaactatgtgctgcaaactattggaaacctcctgattttgagttatgcaaaggtgaaggaccaagccaccttcgaaagtaagctcatctacttactaaatatctgagcgagaaaacttatagacttgtatcttttacaatcagaattctgtccttgaagctggaatgatgtttgtgttctagcttcaaggagtggtaattagcgtttcagttttggaacattggctaaaataactctgttcatgcagttttctatattagcaaagctgaaatatatctatcattgtacgttttggactatattgcttggccaactattctaagtatgggaaacaatgtcggtgtcgagtgacgtatgatttatgtctttttacatgcaggttcacttgtaaggtccttattcagatcacgggaacttcagcgacccttttggagtgctatagcgatcctaagctacaaaagaaagcagcgcatgagcatgcagcagagggagctctgtggtatcttaagcaacttggatacctaccaaaagatgattatcgtgtctagcgacattttaggtttgtggccttcagtgggaagagttttgttattgtaaataggcctcagatggaagagttttgttattgtaaataggcctcagatggaagagtttttttattgtaaacatgcattttgttcagagatatattgacacatacgaagctcacataggataagaaactagcaaatacttcctctatctcaaa

SEQ ID NO: 821 - protein, 900 aa, Sorghum bicolor
MESHNGEADDLPPPPPLNAGVEPLKADETKVPLKHRTLVQRNGFGRKGQQIKLLTNHFKVSLMNAADYFYHYYVNLKYEDDTPVDRKGSGRKVIEKLQQTYAAELANKDFAYDGEKSLFTIGALPQVKNEFTVVVDDVSTGKTPANGSPGNDSPPGSDRKRIRRPYNTKTYKVELSFAARIPMSAISQALRGQESEHTQEAIRVIDIILRQHSAKQGCLLVRQSFFHNNPSNFVDLGGGVVGCRGFHSSFRATQSGLSLNIDVSTTMIVKPGPVIDFLLANQKVNHPGMIDWAKAKRSLKNLRIKTSPANQEQKIVGLSDRPCCEQLFTLKHKNGNGDSEEITVYDYFVKNRGIELQYSGDLPCINVGKPKRPTYFPVELCSLLPLQRYTKALSTLQRSSLVEKSRQKPQERIGVLSDVLQRSNYDAEPMLKACGITIARSFTEVDGRILQPPKLKAGNGEDIFTRNGRWNFNNKRLIKGSSVEKWAVVNFSARCNVRDLVRDLIKCGGMKGIMVEAPFDVFEENPSMRRSPAVRRVEDMFEQVKTKLPGAPKFLLCVLAERKNSDIYGPWKKKCLAEFGIVTQCVAPTRVNDQYLTNVLLKINAKLGGMNSLLQIETSPAIPQVSKVPTIILGMDVSHGSPGHSDVPSIAAVVSSREWPLISKYRASVRTQSPKMEMIDSLFKPRETEDDGLIRECLIDFYTSSGKKKPDQVIIFRDGVSESQFNQVLNIELQQIIEACKFLDEKWNPKFTLIIAQKNHHTKFFIPGKTENVPAGTVVDNKVCHPRNFDFYMCSHAGMIGTTRPTHYHILHDEIGFNPDDLQELVHSLSYVYQRSTTAISVVAPICYAHLAAAQVGQFIKFDEMSETSSSHGGHTSAGSVPVQELPRLHEKVRSSMFFC

SEQ ID NO: 822 - protein, 900 aa, Sorghum bicolor; identical to SEQ ID NO: 821

SEQ ID NO: 823 - protein, 909 aa, Sorghum bicolor
MGSHDGEDEELPPPPPVPPDVVPIKAEDVVGEPPANKPIKPKRLLMDRPGIGRKGQLAQLYSNHFKVAVKSTEDFFFHYYVNLKYEDDQPVEGKGIGRKVIDKLQQTYRAELSNKDFAYDGEKSLFTVGGLPQKNNEFTVVLEDASTGKTAANGSPGGNDSPGGGDRKRVRRPYQTKTFKVEINFAAKVPMSAIGQVIRGEETENSLEALRVLDIILRQHSAEQGCLLVKQSFFYNNPSNFVDLGGGVMGCRGFHSSFRGTQSGLSLNVDVSTTMIVKPGPVIDFLLSNQNVNDPSRIDWQKAKRALKGLRIRTTPANAEFKIFGLSERICKEQTFPLRQRNGSNGDCDTIDITVYDYYAKKGIDLKYSGDLPCINTGRAKRPTYFPIELCCLVPLQRYTKALSTLQRSSLVEKSRQKPQERMTVLNDALQRSNYDSDPMLRACGVSVAPKFTQVEGRILQAPKLKAGNGDDIFSRNGRWNFTNRKFYQTCSVDKWAVVNFSARCDVRNLIRDLMRNASAKGIQMEEPFDVFEESPSMRRAPVSRRVDDMFGQIKSKLPGAPRFLMCLLPERKNCEVYGPWKRKCLAEFGIVTQCLAPTRVNDPYLLNLLMKINAKLGGLNSLLQVEASPSIPHVSEVPTIILGMDVSHGHPGQDRPSVAAVVSSRQWPLISKYRASVHTQSARLEMMSSLFKPRGTDDDGLIRESLIDFYTSSGKRKPDHIIIFRDGVSESQFTQVINIELDQIIEACKFLDEKWSPKFTVIVAQKNHHTKFFQTGSPDNVLPGTVVDNKVCHPKNFDFYMCAHAGMIGTTRPTHYHVLHDEIGFSADEMQEFVHSLSYVYQRSTTAISVVAPICYAHLAAAQVGTFLKFEEMSDTSSSQGGHTSAGSAPVPELPRLHEKVRSSMFFC

SEQ ID NO: 824 - protein, 487 aa, Sorghum bicolor
MESSGTKDGLNKAPILQRLPMSRPHGSGTKGNQIRLRTNHFKVSVHRTDVIFYHYNVSVKYEDDKPVESKGVSRTVIEKLQEIYLANVDFVYDGENNLYTMCALQNVEDAFMVVVEDGSSTKSARSRTPGGNGSPEGSDTKRMKRPMTCKTYKVELKSVGEFCKEKKSVGEIPLSAIDKVLRGQESDDCQEALRVLDIILRQKSAKQGCLLVRQSFFHSPSEPIKLGGGVVRCPGYHSSFRPTQSGLSLNIDVSTTMIVEPGPVINFILSNQYIKDPSRIDWGKAKHALRNLRIKTTHTNSEFKISSLSEKSCYEQKFLLKQRNGNGPDVVEITVYDYYLKHWDIRLQDSAIFPCLVVGKPKRPTYLPIESRICLQLSALPSSVTAKALQRINYNSDDILKKCGISIAPEFAQVDGRILQAPKLKAGDGQDLIARDGRWNFMNRKLFEAKGVHTWAAVNFTTRWKLQDLVRRLIHCGDNKGIVGLCF

SEQ ID NO: 825 - protein, 322 aa, Sorghum bicolor
MGIVTQCIAPSNKMNDQYFTNVLLKINAKLGGMNSKLALEHRQMIPVVTQIPTLILGMDVSHGSPGRADIPSIAAVVGSRCWPLISRYRASVRTQSPKVEMIDSLFKPLDDGKDDGIMRELLLDFYQTSQQRKPKQIIIFRDGVSESQFSQVLNVELNQIIKAYQSMGQGDLPKFTVIIAQKNHHTKLFQADSPENVPPGTVVDSGIVHPRQYDFYMCAHAGPIGTSRPTHYHVLLDEIGFSADNLQKLVLSLSYVYQRSTTAISVVAPICYAHLAAAQMGQFMKFEEFADTSSGSVNSSSSASIPELPRLHADVCSSMFFC

SEQ ID NO: 826 - protein, 913 aa, Sorghum bicolor
MAPSSPSPAAPTRVSGRKRAAKAEEIQEEEVVVASSAKRSRKAPSSGKKPKPTPKQAKPAKAARKKKGEAERKEPVEDDVCAEEPDEEELAMGEEEAEAAADEQAMQEEVAAVVAGSPGKKRVGRRSAAAGGDHEPEFVGNAVPAAEARSNWPKRYERSTAAKKPEEDEELNAKCHYRSAKVDNVVYCLGDDVYVKAGENEADYIGRITEFFEGTDRCHYFTCRWFFRAEDTVINSLVSINVDGHKHDPRRVFLSEEKNDNVLDCIISKVKIVHVDPNMDPKAKAQLIEHCDLYYDMSYSVAYSTFANISSENGQSGSETASGISSDDVDLEAPSSMPERTATLLDLYSGCGGMSTGLCLGAALSGLKLETRWAVDLNSFACQSLKYNHPQTEVRNEKADEFLALLKEWAVLCEKYVHQDVDSNLAGSEDQEDEGSPLDKDEFVVEKLIGICYGGSGRKDGIYFKVQWEGYGPEEDTWEPIDNLSDCPLKIREFVQEGHRRRILPLPGDVDVICGGPPCQGISGFNRFRNRDEPLKDEKNKQMVTFMDIVAYLKPKYVLMENVVDILKFADGYLGKYALSCLVAMKYQARLGMMVAGCYGLPQFRMRVFLWGALSSMVLPKYPLPTYDVVVRGNTPNAFSQCMVAYDEKQKPHLKKALLLGDAISDLPKVENHQPKEVMEYGGSPKTEFQRYIRLSRKDMLDWSFGEEAGPDKGKLLDHQPLRLNNDDYERVQQIPVKKGANFRDLKGVKVGANNIVEWDPEIERVKLSSGKPLVPDYAMSFIKGKSLKPFGRLWWDETVPTVVTRAEPHNQIILHPTQARVLTIRENARLQGFPDYYRLFGPIKEKYIQVGNAVAVPVARALGYCLGQAYLGESEGSHPLYQLPPSFTALGRTAVQARASPVGTPVGEVVEQ

SEQ ID NO: 827 - protein, 1586 aa, Sorghum bicolor
MAADPPPPPPPAQLPPPRRPHKQLQPRGYQVEVFAAALRGNTIAVLDTGSGKTMVAIMLAREHVLRARAGETPRRIVVFLAPTVHLVHQQFEVIREYTDLDAVECHGASGVGDWNAKRWKEAIGSKEIVVMTPQILLDALRHAFLTMCVMSLLIFDECHRACGNHPYSRIMKEFYIDSEWRPAIFGMTASPVSKRGASTIEDCEAQIAQLELVLNAKVYIVEDRNELESFSTGAKIVNKYYDPYLFDLDDLESKLQMLFEEVVKIYNESINTVGDSEDCLFSKASLNLQVSYFKEALFLIEEFLPQGYGELMKSESGSAELTKRGYVSSKVQTLINIFKSFGSSEEVLCMIFVERIMTAKAVERFMRGNVNFSRFSISYLTGGSTSKDSLSPAVQRFTLDLFRAGKVNLLFTTDVTEEGIDVPNCSCVIRFDLPRTVCSYVQSRGRARRSSSSYVLMIERGNLVQQEHIFRIIRTEYYVKTFALHKQPNTPSLDLPLQEKYMYHVESTGATITAECCVNLIYKYCEKLPKDRYYLPKPCFEVGLKDGSYQCALTMPPNAAFRSIVGPPSSTCNLAKQLVCLEACKKLHELGELDDHLVPLTEEPMDIDTDTTDKKCVSGPGTTKRKELHGIINVHGLSGNWIHESETVILNSYTFDFRCDQEGETFAGFVLLMESVLDDDVAHSEIDLFLIPNKMVYTAITPCGKIQLNKEQLRKGKLFQEFFFNGIFGRLFHGSRTSGLQREFIFRKGHEIQWGSDNMYLLLPLRNSSHIQHDLNIYWEAVESCSGAVEQLRNLYLEDGNLNHENLCSHKRSNKGEDIIHLANKSLHFSTVKDSVVLSLHTGRIYSVLDLILDTTADDSFDEMYNGKASPFSSFVDYYHQKYGIVIQHPGQPLLLLKQSHNAHNLLFSKMKYQDGSTGNPLLVEKEQIHARVPPELLIHIDVTTDILKSFYLLPSVMHRVQSLMLASQLRRDISYTQRIPSSLILEAITTLRCCETFSLERLELLGDSVLKYVIGCDLFLRYPMKHEGHLSDMRSKAVCNATLHKHGICRSLQGYIRDTAFDPRRWVAPGQISLRPFPCNCGIETAFVPFTGEYISDDPSFIVGKPCDRGHRWMCSKTVSDCVEALVGAYYVGGGITAAIWVMRWFGIDVRCDMELVQKAKYNSNASQLCYLSKLKVFEELEAKLKYNFSVKGLLLEAVSHPSLQELGVDYCYQRLEFLGDSVLDLLITQHLYATHTDVDPGELTDLRSALVSNENFAQAVVRNNIHSHLQHGSGILLEQVTEYVRSSLEYHGKENEFVQQATFKAPKVLGDIMESITGAIFIDVNFNVDLVWKIVEPLLSPMITPDKLALPPYRELLELCSHLGCFIKSKCTSKGEELIIEMTVQLRDELLIAQGHDRNRKSAKAKAAARILVDLKKRGLSLKQCFSKAKQLDIVSSELQSELISLESRYDCPDVNGSLSLEGLSSVRAAVVLPLKMDKGGPRTALFRLCKRLQWPIPEFEFVEQRFRTPIVLDGVTTTNFNSFVSTITLHIPDVTVITLQGERRTDKKSSQDSASLVMLQKLEELKVCICKQTQQSNMDNNTS

SEQ ID NO: 828 - protein, 1651 aa, Sorghum bicolor
MNLLKRPSNSSPPEDETDKHKRQKRECQDFTPRRYQLDVYEVAMRQNTIAMLDTGAGKTMIAVMLIKHFGKISKANNDRKLIIFLAPTVQLVTQQCEVIKSYTDFEVEHYHGAKGVDQWKAHSWQQQFLKYQVMVMTPQVLLDALRQAFLILDMVSLMIFDECHHATGNHPYTRIMKEFYHGSEHKPNVFGMTASPIIRKGVSSDLDCENQLSELENILDSKIHAVVDREEIELCVPSAKEVNRYYEPRTVSFEDLSEELEILCSKYDGLIVQLHNRSTNQYKDADEITKESRRRLSKSLAKICYCLEDAGLLCASEATKICIERGQRKGWLKGGSDTTDQQSDPNGPILFAEISMLHMKFFQEVLDIIDKRLQQGIDALLNSESGCVEAAKMGYISPKLYELMRVFLSFSDSDNVRCLIFVDRKISARVIERTMKKIGRLSCFRVSFLTGGSSSVDALTPKMQKDTLDSFRSGKVNLLFTTDVAEEGIHIPDCSCVIRFDLPRTTRSYVQSRGRARQRDSQYILMIEKGNVKQSDLISRIMRSKTSMTEIASNREPEDSHRNFFPIEEINEYHISTTGAKITTDSSISVLNQYCDKLPKDKYYTPRPTFQFTHYGDGYECTVTLPSSAMFQLLVGPKARNMQKAKQLVCLDACKRLHQLGALDDHLSPSVEETPLEISSKSSISTSGTTKRKELHGTTKVLSMSGSWGSDKSVTKLQGYKLNFVCDQVDQKYCDFVLLIDTSIAKEAATLNIDLYLHDKMVKASVSPCGPLELDARQMEKTKLFQALLFNGLFGKLFIGSKASKTPREFILKKDDAFLWNKENMYLLLPVDSTQDSHKSVCINWSIVDIAATTVGLMRSIYSDGKHNLKDKLNHEKNDENFIRLANKSCKADDLKNMVVLAIHTGKIYTVLKVSDLCANSKFDGTSDKKEAKFQTFAEYFEKKYNIFLCHPLQPLLVLKPTHNPHNLLSSKNRDEGIILFFVGNVVENKNRANSLVHMPPELLIPLDLPVDVLRVFYLFPSLMHRLESLMLASQLRSEIAYTDSDISSFVILEAITTLRCCEDFSMERLELLGDSVLKYAVSAHLFMTFLNKHEGQLSSRRQETICNATLYRLGTERRIQGYIRDAAFDPRRWLAPGQLSSRPCPCECPVKSEVITEDIHRIDDKSIIIGKACDKGHRWICSKTISDCVEAIIGAYYVEGGLKAAFAVLKWLQIETLEEEQIMEALSSASVRNYLPKVDVVEFLEAKLGYTFQVKGLLIEALTHPSQQESGATYCYQRLEFLGDAVLDILITRHLFLSHKDTDEGELTDLRSASVNNENFAQVAVKHNLHQFLQHSSGFLQDQITEYVNSLEGSSMDRTSLLSSGPSRGPKVLGDIVESIAGAILIDSKLDLDLVWRVFKPLLSPIVTPENLELPPFRELNEWCDKNGYFIGIKCENRGDKTTAILSLQLKDLLLVRQGCGKNKIDAKAHAASLLLRDLEEKGLIIPKNASRVEQFEKNSGTRNHCNNLVDVMDTQNVAPPRQKELPVSSTAPGSVLDKPLVVKVKLSKGGPRVSLYESCKKLQWPMPMFEFVKVEPKNISVCSSSGDSSQKVAPQGYAFASTITLHIPNGDIISLTGDGRADKKSSQDSAALLMLYELQRRGRFQVQEV

SEQ ID NO: 829 - protein, 576 aa, Sorghum bicolor
MADRVGGSDDGDKSEWNSDGEVARSLDGAGSPIAPSRNKLKDAPGPSLLVNGAGPSASLVEDFVGMGLIKGNGDGGAESLLELLLAYKAIGNDPSLDKSSASVCGPRTICDDKDILANWDAHDASTSSDRDHASDDSGDEDFLQGLSQKDEKIESLVRMGFPKDEAEMAIVRCGQDAPMSVLIDLIYSSEASEDGYYGNFSGHEDDSFGGRKEKRKRSEDAEQGSSHDEPMPLPNPMVGFNLPNVSLRSVDRSLPSKAIGPPFFYYENVAIAPKGVWTTISQFLYDIQPEFVDSRFLCAAARKRGYVHNLPIENRSPLLPLPPKTIFEAFPHTKKWWPSWDPRKQFNCLLTSMAKPKLTEQIHHALAKCKDPPPRRVQKYVLETCRTANLVWVGLNKVAHLEPDEMEFLLGFPKDHTRGIGRPERFKSLGNSFHVDTVAYHLSALRDMFPHGMNVLSLFSGIGGAEVALHRLDIRMKTVVSVEISETNRFVLRTWWNQTQTGTLIEITDVQSLTTERLESCIRRIGGFDLVIGGSPCNNLAGRNRFHRDGLEGEQSSLFYHYYRILDTVKSIMGRM

SEQ ID NO: 830 - protein, 740 aa, Sorghum bicolor
MPVAYHQRPAHCWCCLAGAAREFLVETCLEIRRLPLSSKSGQSRDGGGRQSRPVAGAASCSSSSSATASQLPARRGRRRREGRSGRGSPRRGGADGDGRGEAAEVVRGGAERGCAVPLRPVPQPPEPLREGSGMAHWVSDGDGSDSFEWDSDGNGEEAGSFNTAGASSSAMASTNTDAPGPSRRVSQVANGNGKAGPSASLVQRYIDMGFAEEIVVKAIKDNGDNGADALVELLLTYQELGNDLNVDNGFASGCVPQTVDDSGDDDFLENWDDLDAGGRSTRVANSVDDSGDEDFLHEMSQKDNKIDSLVKMGFPEDEAALAITRCGQDASISVLADSIYASQTAGDGYCGNLSDYEDGGRNKGRFMDGNNKKRKRYGSQALGSRGPLDGSADEPMLLPNPMVGFSLPDQWPRPVNRDLPALAMGPPYFYYENVALAPKGVWTIISRFLYDIQPEFVDSKYFCAAARKRGYIHNLPLENRSPLLPKPPRTITVAFPHTKRWWPSWDPRQQFNCLQTCVSSAKLLEKIRVTLTNSSDPPPPRVQKLVLEECRKWNLAWVGLNKVAPLEPDEMEFLLGFPKDHTRGICRTERFRSLGNSFQVDTVAYHLSVLKDMYPEGMNVLSLFSGIGGAEVALHRLGIRMKTVISVEKSEVNRTILRSWWDQTQTGTLIEINDVQTLTSERIEAYIRRFGGFDLVIGGSPCNNLAGSNRHHRNGLEGEHSSLFFQYVRILESVKSIQRL

SEQ ID NO: 831 - protein, 608 aa, Sorghum bicolor
MAHCVGDSDGSDNFEWDSDGDGEEAASFNAAGASSSAMASTNADAPGPSTRVANGNGKAGPSASLVHKYMDMGFPEEIVLKAMKDNGDNGADSLVELLLTYQELGNDLKVDNGFASGCVPQNVDDSDDDDILENWDDEDAGGRSTGVANSVDDSGDEDFLHEMSQTDEKVYSLVKMGFPEDEAALAVTRCGQDASISVLVDSIYASQTAGDVYCGNLSDYEDNSYGGRNKGRFMDANKKRRKRYEGQAHGSRGPLDGSSDEPMPLPHPMVGFSLPHQCTRPVDRSLPSQAMGPPYFYYENVALAPKGVWTTISRFLYDIQPEFVDSKYFCAAARKRGYIHNLPLENRSPLLPIPPKKISEAFPHTKRWWPSWDPRRQFNCLQTCVSSAKLLERIRVALTNSSDPPPPRVQKFVLEECRKWNLAWVGLNKVAPLEPDEMEFLLGFPKDHTRGISRRERYRSLGNSFQVDTVAYHLSVLKDMYPQGMNVLSLFSGIGGAEVALHRLGIRMKTVISVEKSEVNRTILKSWWDQTQTGLLIEICDVQTLTSERIEAYVRRIGGFDLVIGGSPCNNLTGSNRYHRDGLEGEHSSLFYHYVRILDSVKSIMERL

SEQ ID NO: 832 - protein, 693 aa, Sorghum bicolor
MDFDMDDYIDPYEEAEAEAAAGEDDDSDDPDEDDSDAESDYEEKSFGLLKSGKHRVRNPDGTFRCPFCPGKKKQGYKIKDLLQHADGIGVSSKHRRHGRERANHRAFARFVRTDPDFAEDLVGITGIQGAITTTPADKNGGSANGDGKAKANGDTAGSSSVAAKVGPPQEVERFAWPWACVLAAGAGFNPEEFADRVAVFSLVEVVPLFVDEMEVTETFAIVRFTNDWSGFNDALTLENHFGVNKLGKKEFETRDSGLGSVEGDGGKGEVKVYGWVARAEDYDATSVVGRFLRKHTVLKTIDEVSKTELEKSGEMVAILASQIEEKNRYLQDLETKKNATELSISRLEDDNRKLHEAYNEEMRNLHRRARENAMRIFQENENLRIDLENKRRELNLRAKELEKMSAENANDRKTLDDEKQKAKYDNSELELASIEQQRADADVLKLLADQEREKEEVLARMLQLEKELHEKQQLELEVERLNGTLQVMKHLEGDDDGGDIHEKMEKLSVRFEHEKKRLEDLSGDLVRKERESNDELQVARKELIKGLEEELDGQTAIGIKRMGELDEKPFLNACKRKYGKGEYQIKAAELVTNWQEELKKPSWHPFKMVEVNGENKEILVDDDAKLKHLWIEYGDDVCNAVKTALMEINEYNPSGRYVVPELWNFRKGRKATMKEVLKYLFSQMDTTTKRRRG

SEQ ID NO: 833 - protein, 1080 aa, Sorghum bicolor
  misc_feature (1045)..(1078): Xaa can be any naturally occurring amino acid
SELYRGVMAKHQRSGAATGTKKHKAKLQNGEYSIENEEIVTEHEAKTDSNDTTDEPVVRKRPKRAAACSNFKEKEMGLSEEDLIITIKESRVEEEEIEAVRLTKTEPEDRRPSRKLIDFSLHDADGNLQPFEMSEVDDIFITALIMPLDDGLEKDREKGVRCLGFGRIKEWIISGYNEGTAVIWISTEIADYKCVKPASSYRSYFDHFSEKARVCVEVYMKIAKSVGGNPQLDLEELLASVVRSINSNRKSGGTMSKDFVISNGEFIYNQLVGLDKMAASNDEILGTLPVLVALREESQSRVKFNKFSAMPSNGALKIKDEQHMGVGDNDDEKLARLLQEEEEWKMMKQRGKRGTSQKNVYIKISETEIANDYPLPAYYKSYNQEMDEYIFDSDIGIFSDDMPVRILNNWALYNSDSRLIPLELIPMKSDAENDTVIFGSGFMRDDDGSCCSTAESMQLSSSSSKSNQDLGIPIYLSPIKEWVIEFGGSMICVIIRTDVAWYKLRQPTKQYAPWCEPVLKTARLAVSILTLLKEQSRASKLSFAEVIKRVAEFDSVHPAFISSNTTLVERYVVVHGQIILQQFADFPDVSIQRSAFVTGLTLKMEERRHTKLVMKKKSQAMKGENLNPSAKMGPILRKKLMRATTTRFISKIWGDYYATHFPEDTKEGDGNAQKEIDEELEENEDDDDIEEDLNIEMEQAVKTPPSTRSSKSLKSCKEARWKGQIAGKTVSGEFLYKCVTFQDLSIGVGQSVSLEDDSGEAIMCFVEYMYEKHDGTKKIHGRILQKGVQTVLGNAANEREVFLTNDCQEFELGDIKELVTVNVQLIPWGHKYRKENSEVNSIEGEKAEARKRKGLPVEYFCKSLYLPKKGGFFSIPHDKLGTGTGSCSSCEERNQAGDEFKILSGTGFVFKNIRYNVHDFLYIRPDFFSQGEGYETYKAGRNVGLKPYVVCHVLSIDAPDGSNKAHPESTKINVRRFYRPDDISSTKAYTSDIREVYYREDTMSVPLTMIEGKCEVRMKDDLPNSNLPVIVEHGFYWELLFDPVXXXXXXXXXXXXXXXXXXXXXXXXXXXXXXXXXXNL

SEQ ID NO: 834 - protein, 1397 aa, Sorghum bicolor
MLTNEFSGTRRCRAKPQKKEKESTENSKLENGSQDATEEVHHGVEKGDGHVTRKRPRRAAACSDFKEKSIRLSEKKSVVMVKKNRMEEEEIDAVSLTKLGPEDPPPCRKLIDFILHDAEGNPQPFEMSEIDDFFITALIMPMDDDLEKERERGVRCEGFGRIEDWNISGYDEVCEGTAEEEDDDAKLARLLQQEEEWKMMKKQRGRRGTPSQKNVYIKISEAEIANDYPLPAYYKPFSQEMDEYIFDSDDSIFSDDVPVRILNNWTLYNADSRLISLELIPMKSGAENDVVVFGSGFMRDDDGSCCSTAESVKSSSSSSKADQQDAGVPIYLSPIKEWLIEFGGSMICITIRTDVAWYKLRQPTKQYAPWCEPVLKTARLAVSIITLLKEQSRASKLSFADVIKKVAEFDKGNPAFISSNIALVERYIVVHGQIILQQFADFPDETIRRSAFVSGLLLKMEQRRHTKLVMKKKTQVMRGENLNPSAAMGPASRRKAMRATTTRLINRIWSDYYAHHFPEDSKEGDGNEAKEVDDEQEENEDEDAEDEGQIEEDKISKTPPSTRSRKLLSQTCKEIRWEGETSGKTSSGETLYKCAYVRELRIPVGGTVVLEDDSGDTVMCFVEYMFQKSGGAKMVHGRILQKGSHTILDNAANEREVFLTNDCLEFKLDDIKELVSVDIQSRPWGHKYRKENSETDKVEQAKAEERKKKGLPMVYFCKSLYWPEKGAFFALPRDKMGLGSGVCSSCEHIEPDSDELKVLSKTSFVYRKVTYNVNDFLYIRPDFFSEDEDRATFKAGRNVGLKPYAVCQILAIPEGAGSKKLNPASANISARRFYRPDDISTAKAYASDIREVYYSEDVIDVPVDMIEGKCEVRKKNDLASSDLPVMFEHVFFCELIYDRASGALKQLPPNVRFMSMVQKATIASKKNKGKQICETDQIDSGKWLDVPKENRLATLDIFAGCGGLSEGLQQAGVSFTKWAIEYEEPAGEAFSKNHPEAVVFVDNCNVILKAIMDKCGDTDDCISTSEAAEQAAKLPELNINNLPVPGEVEFINGGPPCQGFSGMNRFNQSPWSKVQCEMILAFLSFAEYFRPRFFLLENVRNFVSFNKGQTFRLAVASLLEMGYQVRFGILEAGAFGVAQSRKRAFIWAAAPGEMLPDWPEPMHVFASPELKITLPDGQYYAAARSTAGGAPFRAITVRDTIGDLPKVENGASKLTLEYGGEPVSWFQKKIRGNMMVLNDHISKEMNELNLIRCQHIPKRPGCDWHDLPDEKVKLSNGQMADLIPWCLPNTAKRHNQWKGLYGRLDWEGNFPTSVTDPQPMGKVGMCFHPDQDRIITVRECARSQGFPDSYEFAGNIQNKHRQIGNAVPPPLAYALGRKLKEAVDNKRQEAGVGVPAP

SEQ ID NO: 835 - protein, 1203 aa, Sorghum bicolor
MELHRELPEATLNAIKFDLMTSTDMEKLSSMSVIEVSDVTSPKLGLPNASPQCETCGSKSGRDCDGHFGVTKLAATVHNPYFIDDVVHFLNQICPGCLSPREGINMKKDGSKLYPSVIFKTLSSPRVLLSKSKLHRSPSVMERISIVAEAAERVSNRSKGKGLLEGLPQDYWDFVPSENKQVQSNMTKIILSPYQVFHMLKKSDPELIKQFVSRRELLFLSCLPVTPNCHRVVEIGYGLSDGRVTFLYSKKTDGETSTDPSGMKWLKDAVLSKRSDNAFRSTMVGDPKIKLWEIGIPEDLASNLVVSDHVNSYNFENINLKCNLHLLTKEELFIRRNGKLMFLRKADQLEIGDIAYRPLQDGDLILINRPPSVHQHSLIAFSAKILPIHSVVSINPLCCTPFLGDFDGMKFSCDRMLHILNGEVLTCSLGSSWLQNNTSGLFSVMFKQYGCKALDFLSSAQEVLCEFLTMRGLSVSLSDMFSDHYSRRKLTEGVKLALDEAEEAFRIKQILLDPINIPVLKCQDETEDVTYRQSDCIQNNPSVIRSSIMAFKDVFSDLLKMVQQHVSNDNSMMVMINAGSKGSMLKYAQQTACVGLQLPASKFPFRVPSQLSCIRWNRQKSLNYEAEGTNERVGGQNLYAVIRNSFIEGLNPLECLLHAISGRANFFSENADVPGTLTRKLMYHLRDIHVAYDGTVRSSYGQQIVQFSYDSADDPEVFKCHKATNSGDHIGLLFLSRHLKKYRYGLEYASLEVKNHLEQEMMKKKRLGLRFVIEELTKEYNATRDQLKNAIPSICISRRKCVVGDEGVKISACCIAVVALAEPNSMSQLDTIKKRVIPIILDTLLKGFLEFKDVEIQCQHDGELLVKVCMSHHCKGGRFWATLQNACIPVMELIDWELSRPSNVADIFCSYGIDSAWKYFVESLKSATTDIGRNIRREHLLVIADSMSVTGQFHAISSHGLKQQRTRLSISSPFSEACFSRPAQSFIDAAKQCSVDNLCGSLDAIAWGKEPFNGTSGPFEIMHSGKPHEPEQDESIYDFLRSPKVQNVEKNHLDTRRQSTENASICRLACKSKGSATVNGVAITSDQDFLHAKVSIWDNIIDMRASLQNMLREYPLNGYVMEPDKSKLIEALKFHPRGAEKIGVGVREIKVGLNPNHPGTRCFILLRNDDTTEDFSYHKCVHGAANSISPQLGSYLKKLYHRA

SEQ ID NO: 836 - protein, 554 aa, Sorghum bicolor
MRTLFISKGSGFSSRSVLTGDPYIGLGVVGLPSEVAKRMTFEEQVTDININRLQEVVDKGLCLTYRDGQATYAITVGSKGHTTLKVGQTISRRIVDGDVVFLNRPPSTHKHSLQAFYAYVHDDHTVKINPLMCGPFSADFDGDCVHIYYPQSLAAKAEALELFSVERQLISSHSGKVNLQLGNDCLVAMKAMSDRTVLHKELANQLAMFVPFSLLAPAVMKPIPSWTITQIVQGALPAKLTCQGDTHLVRDSTIIKLDLDKESVQDSFPDLVSSILREKGPREALQFLNVLEPLLMEFLVLGGLSISLRDFNVPKALLEEAQKNIQNQSLVLEQSRCSTSQFVELRVENNLKSVKQQISDYVGKFSGLGLLIDPKKEASMAKVVQQVGFVGLQLYREGKLYSRRLVEDCFSSFVNKHSAIGDEYSPEAFGLVQSSYFHGLNPYEELVHAICTRETMIRSSRGLSEPGTLFKNLMAILRDVVICYDGTVRNICSNSIIQLKYGEDDEADSSSAVPPGEPVGVLAATAISNPAYKAVLDSSQSNNASWESMKVVKL

SEQ ID NO: 837 - protein, 1228 aa, Sorghum bicolor
MEELQKDGGQQSNGSDSEPEAMVLDDNGAGKSHSMDGNRDSPVDVDEGQSSMDVDTKGKPSLNDDVNGKSSEPYSNAPIDLSVESLEKFCKEASRSFFDEVGLISHQINSYNDFVSHGLQELFDSLGEVIVEPGYDPSKKGSGGWKHAIIKFGRVKLEKPVFWTGKDEGSVDFKPWHARLQNMTYASRLIVEVNIQVYSLEKSDKSKTGNDGFVQKRDFMNETHWIFIGLLPVMVKSNLCLLHSLKESECLFDAGGYFLVKGMEKVFIAQELRCLKRLWIIDRPCWMISFMSEMKRRRIYIKLVESTRSEDFSGSKIISISFLYATMPVWLLFFALGISSDKEAFDVIDMQDCDASVINTISATIKESDELCEGFRKSDKARQYVDELVKSSRFPPAESFDDYIARFLFPDISGNRNKALFLGYMVKCLLMAFTGKRKCDNKDDFRNKRLDLPGELLGRELRAHLRLAEKRMVKAIQRDLNSDRELQDLERYIDASIVTNGLSRAFSTGSWCHPYKRAERCSGIVATLRRTNPLQMMSDLRKTRQRVAYAGKAGDARYPNPSYWGKLCFMSTPDGENCGLVKNLAVTAIVSSRVVQPLIESFISCGMSKLNDIPTEHIQRMDKIFLNGNWVGSCKDSASFVFRLRCMRRSSLIDPQVEIKRDKHHKEVRVFSDAGRILRPLLVVENLKKIRKPKGRSFSFQELMQQEIIEFIGVEEEEDIQCAWGIRHLFESEGAISSYTHCELDPSFLLGLSCGIIPFANHNFARRVLYQSEKHSQQAIGYSTTNPHIRVDTLSHQLYYPQRPLFKTVIADCLGRSDYTTFGRKDDFMRPEYFNGQNAIVAVNVHQGFNQEDSLVMNRASLERGMFRTEHLRSYKADVENKDGTKRLKLKEKIDFGKTESKRGRVDNLDDDGLPYIGASLQTNDIVIGKVSESGEDHSIKLKHTEKGMVQKVLLSANDEGKNFAVVTLRQVRTPCLGDKFSSMHGQKGVVGFLESQENFPFTHKGIVPDIVINPHAFPTRQTPGQLLEAALGKGIACKGTMRYATPFTTASVDVIAEQLHRAGYSRWGTENVLNGRTGERMQSLIFMGPTFYQRLIHMSEDKVKFRNTGPVHPLTRQPVADRKRFGGVKFGEMERDCLLAHGSAANLHERLFMLSDFSQMHICQTCERVANVVMRSVSGGKKIRGPYCGFCKSSENIVRINVPYGAKLLYQELFSMGICLKFDTEVC

SEQ ID NO: 838 - protein, 1239 aa, Sorghum bicolor
MEELQKDSGQPSNGSDSEPEAMVLDDNGAGKSRSMEGNEDSPIDADVGKDSPIDVNEGQSSMDVDIKAKSSLNDDVNGKSSSEPYSNAPIDMSVESLEKFCKEASRSFFDEVGLISHQINSYNEFVSHGLQELFDSLGEVIVEPGYDPSKKGSGGWKHAIIKFGRVKLEKPVFWTGKDEGSVDFKPWHARLQNMTYASRLKVEVTIQVYSLEKSDKSKTGNEGFVQKRNFMNETHWIFIGLLPVMVKSNLCLLHSLKESECLFDAGGYFLVKGMEKVFIAQEQRCLKRLWVSDRPFWMISFMHEIKRRRIYIKLVESTRSEDFSGSKVISISFLYATMPVWLLFFALGISSDKEAFDVIDMQDCDASVINTISATIKESDELCKGFRKSDKARQYVDELVKSSRFPPAESFDDYVARFLFPDINGNRNKAFFLGYMVKCLLMAFTGKRKCDNKDDFRNKRLDLPGELLGRELRAQLRLLERRMVKAIQRDLNNDRELQDLERYIDASIVTNGLNRAFSTGSWCHPYKRAERCSGIVATLRRTNPLQMMSDLRKTRQRVAYAGKAGDARYPNPSYWGKLCFLSTPDGENCGLVKNLAVTAIVSSRVGQPLIESFISCGMSKLNDIPTEHIQRMDKIFLNGNWVGSCKDSASFVFRLRCMRRSSMIDPQVEIKRDKHHKEVRVFSDAGRILRPLLVVENLNKIRKPKGRSFSFQELMQQEIIEFIGVEEEEDIQCAWGIRHLFESEGAISSYTHCELDPSFLMGLSCGIIPFANHNFARRVLYQSEKHSQQAIGYSTTNPHIRVDTLSHQLYYPQRPLFKTVIADCLGRSDYTAFGRKDDYTRPEYFNGQNAIVAVNVHQGFNQEDSLVMNRASLERGMFRTEHLRSYKTDVENKDGTKRLKLKEKIDFGKTESKRGRVDNLDDDGLPYIGASLQTNDIVIGKVSESGEDHSIKLKHTEKGMVQKVLLSANDEGKNFAVVTLRQVRTPCLGDKFSSMHGQKGVVGFLESQENFPFTHEGIVPDIVINPHAFPTRQTPGQLLEAALGKGIACKGTMRYATPFTTASVDVIAEQLHKAGYSRWGAENVLNGRTGERMQSLVFMGPTFYQRLIHMSEDKVKFRNTGPVHPLTRQPVADRKRFGGVKFGEMERDCLLAHGSAANLHERLFMLSDFSQMHICQTCERVANVVMRSVPGGKKIRGPYCGFCKSSENIVRINVPYGAKLLYQELFSMGICLKFDTEVC

SEQ ID NO: 839 - protein, 1251 aa, Sorghum bicolor
MDGDQSTVVLDTDMMDCLNFDGYGDVEDPRKEGAKGERQPSGKVDELQSTMDVDLTCIAYVEDEGNEKQNAMDVDLKEILPEEDEGKGKASSDIPSHVPVDFDVASLEKFCREASRSFFSATGLVSHQINSYNQFVSHGLQDLFDSLGEITVEPDYDPSNKSGAWKHATIKFGRVELSEPVFMVDNLDLEQQDLKFKPRHARLQRMTYASRMNVEMTAQVYILDKSDKAKTGKDTHVHRREIMTETKQVSMGLLPVMVKSNLCWLHKLQESDCQFDFGGYFLIKGTEKVFIAEEQRFLSRIWITDYPSWDASYLSQIKREKINIKLVPSKRNESCKVITIYFMGTIIPIWVVFFALGVSSDKEAFDMIDILDCDASIVNIISSTIKESHEEFEGFRAPGRACQYVDKLIRKSKFPPKESFDEYVCRYMFPSVNGVRSKALFLGYMVKCLLMAYSGNRKCDNKDDFRNKRLGLACQLLRRELWTHIKRAEWRMVKLMQRDLSNDGNLQDLRRYVDASIITNGLNRAFSTGSWRHPYLKARCSGVVATLRRTNPLQMMSDLRKTRQWVAYSGAVGDARYPNPSFWGKLCFLSTPDGEKCGFVKNLAVTAVVSSVVRKPLIDTFVSCGMKKLDDISLQDISGKDRIFLNGSLLGVCADPHELTLRLRSLRRSKLIDPQVEIKRDKHHKEVRVLCDPGRILRPLLVVENLRRITRPKDGLYSFQELIDQNIVELIGVEEEEDIQCASGIRHLFSGEKEDRSSGYTHCELDPSFLLGLSCSLIPFANHDNGKRVLMQAEKISQQAIGYSPTNSHTRLDTLSHQIFYPQRPLFKTVVSYGLGKAETAYSFGRKDDFNTPEYFNGQNAIVSINVHQGFNQEDSLVLNRASLERGMFRTLHLKSYKAQVENKEITRRLKHRESINFGKVQSKRGKVDSLDSEGLPYVGASLQSGDIVIGKVSESGEDHSAKLMHTEKGMVDKVVLSANDDGVNFATVTLRQSRSPCVGDKFASMHGQKGVVGLLDSQENFPFTCQGIVPDIVINPHGFPTRQTPGQLLEAALGKGIAMGGKVRYATPFTTPTVDVITEQLHKAGFSRWGEESVLNGQTGERMKSLVFMGPTFYQRLVHMAEDKVKFRNTGPVHPVTRQPVEDKKRFGGVKFGEMERDCMLAHGAAANLHERLFTLSDFSQMHICQACQRVANVIMRPAEGGSKKVHGPYCMFCRSAERIVRVNVPYGSKLLYQELFCMGICLKFDTEIR

SEQ ID NO: 840 - protein, 1128 aa, Sorghum bicolor
MSMAAPAPGATATVRVANIPASAIAAELLAFFDSAVTTTGAAFACEIAAAHRGWLSRGHGSVQFDSSAAAIHAIDLASSGRLPPFLGSCLSVSPAHADLLPRAPDLSLRAADAGLILGNRVAERELEAAYSWDGVRAEVIPRKRRVDLYLKQDSRSYKLEVLFEDIRECFGCHLDGTGAILLQLTYAPRIYTAISGSTVKSRFTDDRFHACKEDAKFAWVRALDFTPNNSFGECSTLVLKLSKGVPVSDILESLPFSGELEELAISSMLAFGSSSNVVPLVDCPNGFSVPYEVLFRLNSLVHMGKLVARHVNADLFKVLEELSIDTLRRIFEKMSKLKSTCYEPLQFIRHEAHSMSKSKKAFLSNKKDGGKLMRCYRIHITPSKIYCLGPEEEVSNYVVKYHSEYASDFARVTFVDEDWSKLSPNALSARTEQGFFSTPLKTGLYHRILSILKEGFCIGPKKYEFLAFSASQLRGNSVWMFASNNSLTAESIRRWMGHFEDIRSVSKCAARMGQLFSSSRQTFEISSYDVEVIPDIEVTSDGTKYIFSDGIGKISTRFARQIAKLFGLDPAHPPSAFQIRYGGYKGVITIDPTSFFNLSLRPSMKKFESKSTMLNITNWSKSQPCYVNREIISLLSTLGIKDEVFESMQQDDMHESDGMLTNKEAALSVLGKIGGADTKTASEMVLQGYEPSSEPYLLMILKAHRANRLTDIRTRCKIHVQKGRVLIGCLDETCTLDYGQVYIRITKNRKEQKYSEQPFFCNDDGKTAVIVGKVAVTKNPCLHPGDVRVLEAVYDPALDARGLIDCVVFPQRGERPHPNECSGGDLDGDLFFITWDDKLIPEKVDAPMDYTATRPRIMDHAVTLEEIQKHFVNYMINDALGVISTAHLIHADRNPLKARSPECLQLAALHSMAVDFAKTGAPAEMPVALRPREFPDFMERWERPMYVSTSVLGKLYRAALRHEENAEALLPAGPPRCVYDPDLEVAGFDKFLDTAEEQYEVYAEKLGTLMTYYSAEHEDEILTGNIRNKLVYLRRDNKRYFEMKDRIIAAVDALHAEVRGWLRARKEDDASKLASAWYHVTYHPDRRGEKRFWSFPWVACDTLLAIKAARRCRKRVEDAAAPMDCDAS

SEQ ID NO: 841 - protein, 1207 aa, Sorghum bicolor
MGSLRGAAAPSPAPRAGDLVTTQVSLGGFDATVKALDLADFLELKAGLVWRCRVKTSWTPPDAYPDFLLPTVTSAAAQPPQYDRVPPHAFVHFARPEGARAAADAAGRSELILSGKPLRAASAQESSLRASRRRSVSPFRFPGSRLEVGDLPAKDAFLAAWRGPASGLEFSVDPFDGSCRLIFARDTAFKVREFRESVVMRCDVKLEFPVRDVAEVRVFRLDCSLLIRLSAAPLVYYRTADDDIHESVPFDLLDDDDPWIRTTDITPSGAIGRCGAYRITFSPRFWPKMERALAYMRDRRVPIVDCGGGWGARRGLTVRDEPEFGERMQDLFFCVQHSEGLKFPVLFLVNALVHKGVINQHHLTPEFFGLLQRKEDDVNVAALREFWGDKFPVFDACGRLKNLQDRVARYPKLLRNKIGDDNSEVRRLVVTPTKAYCLPPEVERSNRVIRHYREVTDRFLRVTFMDEGMQLLNSNVLNFSAAQIVKDLMSNSFLHKTTVYKRIKTFLTEGFHMCGRKYSFLAFSSNQLRDRSAWFFAEDRMRTVETIRKWMGRFTSKNVAKHAARMGQCFSSTYATVVMQPHEVNECLEEVERNGYIFSDGIGKITCDLALEVAQKLRLTDNPPSAYQIRYAGFKGVIAVWEGENDGIRLSLRPSMHKFESNHNVLEVVSWTKFQPGFLNRQIITLLSSLNVPDAIFSQMQEAMLSNLNNILSDTDVAFDIVTTSCAEQGNTAALMLSAGISPGTEPHLKAMLLAIRSSQLLGLLEKTRIFVPKGRWLMGCLDELGILEQGQCFIRASSPSLNNCLVKHGPRFSSANKNAETIVGTIVMAKNPCLHPGDVRILEAVDVPELHHLVDCLVFPKKGERPHANEASGSDLDGDLYFVTWDENLIPPGKKSWNPMDYSPTEAKQLPRAVSPHDIVDFFLKNMVNEKLGPISNAHVVHADMSEYGAMDEKCIQLAELAATAVDFPKTGKIVSMPPSLRPKLYPDFMGKEDAISYKSEKILGRLYRSIQEASSGDLVPEETCTLNDLPYDADMEVPGATDFLSSAWECKCSYETQLNALLNQYGVRTEAELVTEHIWSLPKYSSRKQGDIKERLKNAYSALHKDFRSIFESFVTDQTEISDDEKIRFYEMKASAWYQVTYHPKWVQKSREMLKPDFEDMPARLSFAWIGVEHLARIKIRCHGEVKVDSRRPVERLAAYISGSM

SEQ ID NO: 842 - protein, 1220 aa, Sorghum bicolor
MVVSPAEPVTTRVSVGGFDSRFTSPRELADYLEAVAGRVWRCRVKTSCTPPNSYPDFQCLPLLPAANAHQPPPHYSSRARRRRAPDGEDDGALAFQAAPTPYNLVPPHAFVHFVHPEAARRAARSGILVRASSSSQNKSSAAVRDRAVRRQNAKPFRFTNARVEVGNLWAPDAFVVSWRCPGNSGSSASSGLDFVVDPLDGSCRLLFSRDTAFAFPASREAAVVLRCDFKVEFFVDDIAELLVFPTDDSLLLRLSAAPLLYYRTAADGVHQSVPFDLLDDDDDDPWIRTTDITASGAIGRCWMYRISFKTWFWPKMKDALAYMKEKRVPAVVCDIGSPGFRVHDEPEFGKPMQDLFLCVQHVEELQFSVLFLVNVLVHKGIVNEHQLTSKFFSLLKREEEQVNVAALTELLGENSQVFDVCWRLKNVQDWVAKNPKLIHPRSRGKVAGDYNAVVRRLVITPTRAYCMPPQVERSNRVIRHYHHVADRFLRVTFMDEGMQLLNNNALSFHAAPIVQSMMSKLFQHKTRIYRRVHTLMTKGFHLCGRKYSFLAFSSNQMKDRSAWFFAEEGTTTAATIREWMGQFPSRNVAKHAARMGLCFTSSYATVVTRPNEVNELLEDIERNGYNFSDGIGKITPDLAIEVAARLPLIDRYPPSAYQIRYAGFKGVIAVWPGQNDGIRLSLRPSMRKFESTHSVIEVVSWTKFQPAFLNRQIIILLMSLGVPEAIFWEMQEAMLKNLDRILSDREIAYKVVTNSCPERGTIARLMLSAGFSPATEPHLKAMLLAIKSSQLKGLLKKTKIFVPKGRWLMGCLDELGILEQGQCFIQASSLSINNHFMKHGSRFSSANKNAVTIVGTVVVAKNPCLHPGDVRVLEAVDVPELHHLVDCLVFPKKGERPHPNEASGSDLDGDVYFVTWDKNLVPPGKRSWKAMDYSPAEAKQLQRRVLQHDLIDFFLKNMASENIGRISNAHVVHADISEYGAMDEKCIQLAELAATAVDFPKTGKIVRMPPSLRPTKYPDFMEKDDAISYKSEKIIGKLYRTVRYYILGMPLESLIKDGMPAYDIDLEVPGASHFFLDAWQWKCAYESRLNALLNQYSGCTEAELVTGVIWSLADGRKRKKHEANEKFSHAYPELHQEFRRVFENIAADQDRMSDEKKNLVYEMKASAWYQVTYHPEWIRFSREKEPHGEERPARLSFPWIAIDYLACIKMRCRGQAKHFT

SEQ ID NO: 843 - protein, 1239 aa, Sorghum bicolor
MAAHNRSRSPESTRRRAHLHRSLKPSKPNQHHPRERCRQTAGHPLPGCNFAMVWPTGLATRAILTGFDAGLSARGLADDLEHVAGTVWRCRVKTSITPPKSYPDFHLPAILAAAVLHPDGPSRHGRVAPHAFVHFEQLKAANHAGDFFKMRISAQNTYLLHGRAACPRDGGTDMRRPMLFPDSCVEFGDIVPPDTFFVAWRGTDHSASAVDFIVDPSVGCCRLLFSRDTAFTFPDLCRRPTVVLCCDIKLEFSVSNVAEVLVFEADDSLILRLSAAPLVYYRTAGDDVQDRVPFHLIDTDDDPWIRTTDVTPSGAIGRCSAYRVSFGAMFWPTMRTALKYMERQGVPVDVRDSRWLGFTVLEEPDFGRPMQHVFFSLRQDEDLWFPELYLVNVLIHNRIVNLHQLTSEFFSLLRRAHEDVNVAALTELFGAKLQVCSNPCSRLKNAQDRATKNLNLLFHGSSRKLGDFNAEVRRLIITPTRTYCMPPQLERSNRVTRHYHQLSDRFLRVAFVDEGMLPLNANALSLQVVPLVKDLMSSPTQQMTTVYRRVQTILTEGFTMCGRKYSFLAFSTSQLKQKSAWFFAEDGTTTVASMKEWMGQFPIRNPAKHAARMGLCFTSSYATVTMQPCEVDEYLEDVIHNGYNFSDGIGMITQDLALEVAKRLQLTDIYAPSTYQIRYAGFKGVVAVSTGQNDGMRMSLRPSMRKFESAHSVLEVLSWTKFQPSFLNRQIITLLTSLGVPDAVFWQMQEAMLGNLKRILSDNNVAYEVVTNSCPEHGSTAGLMLSAGFAPATEPHLRAMLLAICASQMQGLLDKTRIFVPKGRWLMGCLDELGILEQGQCFIQVSTPSLNNCYVNRGSIFPSEYKNNAEIIVGTVVMAKNPCLHPGDVRILEAVDVPELHHLVDCLVFPQKGERPHANEASGSDLDGDIYFVTWDENLVPPGRQSGTPMDYFPAKTKQLPREVHQSDIIDFYLESMVNDNLGRICNAHVVHADRSDDGAMDPKCIQLAKLAAIAVDSAKTGEIVRMPPSLSPKEYPDFMGKGDAISYKSKKILGRLYRSILRENGDDFVSQGTCISNETPYDIDLEVPGALSFLEDAWQCKCLYEAQLNTLLSQYGLRSEAELVTGEIWPLVGYNKYQYQLKERINYAYSKLHQEFRSIFESIDISYCDNKNLAYEMKASAWYQVTYHPEFIRLREPDDEKTPARLSFAWIAVDYLAQIKKKCHGEMKVEEGRSAYIF

SEQ ID NO: 844 - protein, 1251 aa, Sorghum bicolor
MAAHSRRSRSRSPESARRRAHLHRSLKPSKPTQHHLHESRRLQTADRPPLGRNNFAAVAWPTEPATRVVLTGFDAGLSARGLADDLEHLAGTVWRCRVKTSVTPPESYPDFQLPVHPADDDDAAVFHHQDEPSRHGVVAPHAFVHFEHPNAADRAGHFFRKRVPAQSSYLLHGRAARPPRDGGTDDTRGRPMLFPDSHVEVGDVVAPGTFLVAWRGTDDDSASASALDFVVDPSAGCCRLLFARDTAFTFPDFHRRPAVLLCCDVKVEFSVADVAEVLAFEADDSLLLRLSAAPLVYYRTAGDDVHDRVPFHQIDVDDDPWIRTTDVTPSGAIGRCSAYRVSFAARFWPTMRAALEYMKKQGVPVDVCDSRCRGVTVLEEPDFGRPMLDVFFSLRHDEGLRFPELYLVNVLIHNGIVNPHQLTSEFFSLLRRAQEDVNVAALTELFGTKLHQVCNDPCSRLKNAQVRAAKNLNLLSNSSSRKFGDYNVFEVRRLIITPTRAYCMPPQVERSNRVTRHYRQVSDRFLRVTFVDEGMLPLNSHALSLHVVPFVKDSMSSSSQQMTTVYRRVQTILTEGFTMCGRKYSFLAFSTSQLKQKSAWFFAEDGTTTVASMKEWMGQFPIRNPAKHAARMGLCFTSSYATVTMQPCEVNEYLEDVIHNGYNFSDGIGIITQDLALEVAKRLPLTDIYAPSAYQIRYAGFKGVVAVSPRHNDGMRMMSLRPSMRKFESVHPVIEVVSWTKFQPAFLNRQIITLLTSLGVPDDVFWQMQEAMLGNLKRILSNTDVAYKIVTSSCPEHGSTAGLMLTAGFAPATEPHLRAMLLAICASQMKGLLDKTWIFVPKGRWLMGCLDELGILEQGQCFIRVSTPSLNNHYMNRGSISPSEYKNNAEIIVGTVVMAKNPCLHPGDVRILEAVDVPELHHLVDCLVFPKKGERPHSNEASGSDLDGDVYFVTWDENLVPPGRKSCTPMDYSPSKSKQLPREVHQQDTIDFYLESMVNDNLGRICNAHVAHADRSDDGAMDTKCVELAELAAIAVDSAKTGEIVKMPPSLSPKEYPDFMGKEDAISYKSKKILGRLYRSILMENSGDLLSQVTCISNENQYDTDLEVPGALSFLEDAWKCKCLYEAQLNTLLNQFGVHSEAELVTGEIWSLVGYNKKYQYQLKERLNYAYSKLHQEFRSIFESIDVSYGDSKNLAYEMKASAWYQVTYHPEFIRLRELDDEKTPARLSFAWIPVDYLAQIKKKVSWRNES

SEQ ID NO: 845 - protein, 590 aa, Sorghum bicolor
MSGSGDRRGGGPPGPDGGWKTKGKNSKKHGQVGGSQWTPGSSTNATPSTARPAWGGNGSSHPSGRTWAQASDRGAGNRCNPRPPPPTLRPVVTPPLANGWQWQSRPRPSGSEVEKDDASPSGSDPEVENVDGNNASDDDDDLSDDISDEYDSDASEKSFETLKTNKWFKKFFEKLNTLSVEQINEPAREWHCPACKNGPGAIDWYRGLQPLMTHARTKGSKRVRLHRELAALLGEELSRRGTSVVPAGEQFGKWKGLQESTDREIVWPPMVIVMNTLLEKDDDDKWKGMGNQELLDYFGEYAATKARHAYGPSGHRGMSVLIFESSAVGYMEAERLHRHFVNQGTDRNAWQLNKARFAPGGKRLLFGFLASKEDMEAFNKHCHGKSRMKYEMKSYNEMVVMQMKQMSEDNQQLNYLKNKVVKTEQHSKAVEESLGVVSQKLRETMEENIFIRSKAKEKHLEYEQEMKYQEEFFHSQIEDIHKATEDKEKLFEKLLQEERSKARRFDVDSGTTEDRKLRKEHVQKFIDCQVKDVEKFEAERDELIKVHDETKMRLKKEYMEKELELEKELDAALTGLMEKHKPDSFEASSS

SEQ ID NO: 846 - protein, 587 aa, Sorghum bicolor
MSGSGDRRGGGPPGSDGGWETMGRKSKKQGQVGGRQWASWNSTNATPNTARPAWGGNGSSHPSGTSWAQASDRGAPNRCNPRPPPQTVRPVVTPPLANGWQWQSRSRTSGSEVEKDDAPPSGSDPEVENVDGNNASDDEDDLSDDISDDYDSDASEKSFETRKTNKWFKGFFEVLNTLSVEQINEQTRQWHCPACKNGPGAIDWYKGLQPLMTHARTKGSTRVRLHRELAALLEEELSRRGTSVIPAGEQFGKWKGLRESTDREIVWPPMVIVMNTFLEKDDDDKWKGMGNQELLDYFGEYAATKARHAYGPSGHRGMSVLIFESSAVGYMEAERLHRHFVNQGKDRNAWQLNKVRFVPGGKRLLFGFLASKEDMEAFNRHCHGKSRLKYEMKSYNEMVVMQMKQMSEDNQQLNYLKNKVVKTEQRSKAVEETLGVITQKLRETMEENIFVRSKAKEKHLEYEQEMKYQEEFFHSQIEDIHKATEDKEKLFEKLLQEERSKARRFDVDSGTTEDRKLRKDHVQKFIDCQVKDVAEFEAERDELIKVHEEKKMKLKKEYMEKELELEKELDAALTVLMEKHKPDSFEA

SEQ ID NO: 847 - protein, 666 aa, Sorghum bicolor
METSPPPPPPPPPPPQIDHLLSQFPIIPKPDPDGPTPAQTPAPIAERSAALMLALTPELCQVLHRELAPSPDDDPYFARCLRQSQLHLEALAASLRPPSSSSSSSSAAAAAASLARVLPPPPPPQKELRTQLQREPGAGGGSNPSSSKKRARASTEVVRATHLSPADHLRYRALVRRARLTFEALRSTYQRQETSSGVRNRHDLRASRQMLSAGHWLHREVRIVGDIPGVFVGDAFYYRAEICVVGLHTMPQAGIGYIPGSLLNEGDPVATSIVSSGGYLDDEDTGDVLVYTGSGGRQRNRVDHHANQTLERGNLALHNSYLYGVEVRVIRGHDIDQGPHRKVYVYDGLYRVIESTFGPGKSGHDVCKFKLVRLPGQDDLASKTWHTAKLLKESMDARIRPPRYISLDLSKGAELLRVPVCNKVDNDRSPLLFEYIAQPEFPVRPAHVPVKQHGGCHCAGGCGSKCRCERKNGGEPVYTEDDILVMGRPVVYECGALCGCPMTCVNRVTQRGMKHRLEVFRSIETGWGVRALDLIQPGAFVCEYTGHVVVMDDQPGSALEGRSIIDPRRFPERWKEWGDASAVEPNMKRLQFAKFAGPGYVLDVSHKRNVACYISHSCTPNVFLQFVLRGNEDESFPHLMVFAMETIPPMRELSIDYGIDMELSAI

SEQ ID NO: 848 - protein, 1385 aa, Sorghum bicolor
MAEEDPLPPCDPQTQARWYQLEALERALAGNTLVFLETGAGKTLIAVLLLRRFANRIRSSPPPCFAVFLVPTVVLVSQQARVVRAHTDLTVAEFFGEMGVDFWNADKWRDMVDGAEVLVMTPQILLDNLRHSFFRLRDIPLLIFDECHHATGNSPYACIFKEFYHPQLNSRPSDPIPRIFGMTASLINSKDLARDKYSMKISELENLMNAKVYTVASESELLQYIPFATTRIIEYDDYIVKSELYSHTIRCLDKLEAKHLEILKGKLHGSYLENAEKRIKKLNAMFLYCISDLGVWLAAKAAEILQSNKESCVSFWGEKLDDEVEGFIRNYIGDVNNELSEIILKMTKRGLQRHIGEDFDADLQDGLLKSKVYFLIKSLLEYRHVQDLRCIVFVKRVITSIVLEALLSTINQMSGWSVRYMAGKNFGLQYQSRNTHVEIVDSFRSGKVHLIIATQILEEGLDVPSCNLIIRFDQAATNVDGGCLFDGVRDTSVFCFDGGDANALSKTEEFLESGQIMREESQRLESTFYQPLPNTLCNEEFYGVQSTGAIVTLNSSVQLIYFFCSKLPSDESVFFLRLDNVFFWFIQQNISWYFNPLPRFNIDKALGTCTLHLPMSSPVQTIYAEGEISIIKRVVCLNACRELHAVGALTDYLLPESSVPCEDEPDIVVDKYKEEQPDYFPEQLMDNWLSFCHRGLYYCYKISLEGCSETTTPAEIVLAVKCDLGSDFISTTFKLWGVQDYLSFTIRYVGVIHLNQEQVIVARRFQTRILSLLISKDLSEDGNSIKSLLEMQVSSGAVYLLLPVVSGKIDWCSIKFSSSEMHEDTIMDSRHSHSCKDTGLLQTKGGPFCPCMLQNSIVSTPHNGMLYAVSGLLLDLNANSPMRESVLSYKTHFKESHGLDLKCEDQPLLRASKLVKVRNILHERNYKKEKESTNVFELPPELCIVVMAPVSANTLRCFTFIPSIMYRIQCMLLSVNLKTQLGPSMKQFDIPALKVLEALTAKKCKEEFSQESLETLGDSFLKAWAFAAVVNCGILFLLWRSDQAKGYIRSETFNPETWIIPGVGNDSCGRSLRKLKSKRIADSVEALIGAYLSAAGEQAAYLFLKSLGMDIEFHKMPVERKITINAENFINLRSLELMLDYNFSDPSLLLEALTHGSYQIAGTTACYQRLEFLGDAVLDHIFTDYFYHQYPECTPELLTDLRSASVNNSCYAHAAVKAGLHKHILHSSSALHKKMADYLDKFEQSFSGPSHGWEAGICLPKVLGDVIESIAGAIYIDTKNDKKVVWRKMKRLLEPLATPDTLEIDPVKELHEFCDPKTCSIKYTVAREDRVTSVAVEVQTKGTTYKATRTGLTKRDAKKLAAKSVLKDMKAANSTQHFANGISCT

SEQ ID NO: 849 - protein, 698 aa, Sorghum bicolor
MEHFVELPPELCSLKITGFSKDMGSSLSLLPSLMCRLENLLVAIELKNVMSSYFPEASQISASGILEALTTERCLERISLERLEVLGDAFLKYVVGRHNFISYEGLDEGQLTRRRSDIVSNSNLYELSIRRNLQVYIRDQHFEPTQFFALGRPCKVVCNPDREATLHPKNIDPDRRENCNLRCTKSHHWLHRKTIADVVESLLGAFLVECGFKAAFAFLRWIGIKVDFENSALYRVLDASSTNLSLMNYMNISELEELIGYTFKHKGLLLQAFVHPSFNKHSGGCYQRMEFLGDAVLDYLMASYLYSAYPDLKPGQLTDLKSLALNNNSFAYVAVKKSIHKYLIKDSKSLTAAINKFQNYVNLSSSEKDLLEEPTCPKVLGDIVESCVGAVLLDSGFNLNHVWKLMLMLLKPILSFCGMHIDPMRELREICQYNGFELGLPKPTEDNGEFHVKVEVNIDGKMISCTAANRNSKDARKVAAQEALLKLKNNGYKHKRKSLEEILRATTKKESELIGYDEEPINVEDDIQMKNLLINGEMEGNIFFQNKEVSLNGRSETSIQSTTGDNKVDKNDANNGRNNKSNVVVQNGCLPRGATDKTNQREYHGDMVRKTARSFLYELCAANYWKPPDFELCKGEGPSHLRKFTCKVLIQITGTSATLLECYSDPKLQKKAAHEHAAEGALWYLKQLGYLPKDDYRV

SEQ ID NO: 850 - protein, 1067 aa, Sorghum bicolor
MAYRGGGRGGGRGGDRGDQRPPYGHGGAGGSGGGGGGRPFIWPPPPSTPRPVMPAPPPGPYPVPVPMGGYRGPMVMPHPGAYGVPMAVYRPSGQAAVFRAPAPAAPQVSFSPAPPAAPVTIRAPPPSSKTTSPAAPSSTTPAPPRQSARQSASTPASDSAPAASSAPSPAAALAKEVEKKLFVSETALAPPASAAHGTAAARADEASDLDLAPVSKKGLAHPARPGLATVGKKVMIRANHFLVNVADNNLFHYDEVDCRSVPFRKRLLPEHGIGKTIGQMRWKSCICLVAINPESKSRQTNREVLNELIKLHGKTALGGKLPAYDGRKSLYTAGSLPFESEEFVVTLVDPEKKDKESYVTVSRSFFSTTFGHRGDIGEGLECWRGYYQSLRPTQMGLSLNIDISATSFFKPVSVIKFVEEYLNMRDTSRPLSDRDRVKIKKALRGVRIETTHQQDQIRRYKITGVTSIPMSQLIFPVDDKGTRKTVVQYFWDKYNYSLKHGSWPCLQAGSDSRPVYLPMEVCKILEGQRYSKKLNDRQVTNILRATCKRPQEREQSIHDMVLHNKYADDRFAQEFGIKVSSDLVTVPARVLPPPLLKYHESGREKTCAPSVGQWNMINKKMINGGTIDNWTCLNFSRMRPDEVQRFCMDLIHMCNATGMVVNPRPFVDVKSAAPNHIENALRDVHRRATQMLAQQGVGNQLQLLIVILPDVSGSYGKIKRVCETDIGIVSQCCLPKHASRPNKQYLENVALKINVKVGGRNTVLERAFVRNGIPFVSEVPTIIFGADVTHPPPGEDSASSIAAVVASMDWPEITKYRGLVSAQPHRQEIIEDLFTVTKDLQKGHSVNGGMIRELLIAFRRKTNRRPERIIFYRDGVSEGQFSHVLLHEMDAIRKACASLEEGYLPPVTFVVVQKRHHTRLFPEVHGRRDMTDKSGNILPGTVVDQQICHPTEFDFYLCSHAGIQGTSRPTHYHVLYDENHFTADALQSLTNNLCYTYARCTRAVSVVPPAYYAHLAAFRARYYVEGESSDGGSTPGSSGQTVAREGPVEVRQLPKIKDNVKDVMFYC

SEQ ID NO: 851 - protein, 1036 aa, Sorghum bicolor
MASRGRGFGGGRQGPGGGRGSEGRGRGIGGGGGYQQPYGRGGDGGGESGGRGGVGRGRGVGGRGNGGGRGPGGRGGVGYQQPPPPPLGNVEVGGRGRGGVAVAVPVPARPAAPRPLAPVVAAPAVPAAASSSAPPAQAPRAPAGAAGGGAALAAGMGRLAVADNPAPPAPAAGRSEAQGPAHRPPPPPLSSKGITPPARPGFGTLGRKLIVRANHFAVQVADNDICHYDVLINPEPKARRTNRVILSELLKVHGATSLAHKIPAYDGSKSLYTAGELPFKSMEFVVKLGRREIEYKVTIRYAAQPNLYHLQQFLKGQQRDAPYDTIQALDVALRESPSLNYVTLSRSFFSKKFDNGVDIGGGLESWSGYYQSLRPTQMGLSLNIDICSTSFYQSIPVVKFVDDCLGLTNPAQPFSDRDRLKLKKALRGVRVETTHQQGKKSAYKITGITPVPLAQLSFSCNEGPQLTVVQYFAERYNYRLRYTAWPCLQSGNDSKPIYLPMEVCQIIEGQRYPRKLSDTQVTNILKATCKRPQEREGSIIQMVHRNNYSADKMAQVFGITVANQMANVQARVLPAPMLKYHESGREKTVAPSLGQWNMINKKMVNGGTVHSWTCLSFSRIQLHIVDRICEDLAQMCNSIGMDFNPRPVTEVQSASPNHIEAALRDVHMRAPNLQLLIVVLPDVSGHYGKIKRICETDLGIVSQCINPKKNKNKQYFENVALKINVKVGGRNTVLERAFVPNGIPFVSDVPTIIFGADVTHPTAGEDSSASIAAVVASMDWPQVTTYKALVSAQAHREEIIQNLFWTGTDPEKGTPVNGGMIRELLTSFFKRTGRKPKRIIFYRDGVSEGQFSHVLLHEMDAIRKACASMEDGYLPPVTFVVVQKRHHTRLFPEVHGRRDLTDKSGNILPGTVVDTSICHPSEFDFYLCSHAGIKGTSRPTHYHVLYDENRFSADALQFLTNNLCYTYARCTRAVSVVPPAYYAHLAAFRARYYDEQESTDGTSVVSGSAATAGGGPPAFRRLPQIKENVKEVMFFC

SEQ ID NO: 852 - protein, 975 aa, Sorghum bicolor
MAPPPPPPPPQAQARHHHHHHQGPANKGGGHAERTKQPLQSSVTQPKAEPPAVVAAAVLPEGGKRCGGGGGGRRRGGRGRAKAPPGESRAALAVAVAPAPAQAPPPRTVIGPPVPSKGLSFCRRPGFGTVGARCVVKANHFLAELPDKDLTQYDVKITPEVSSRTVNRAIMAELVRLYRASDLGMRLPAYDGRKNLYTAGTLPFDSREFVVRLTDEDDGTGVPPREREYRVAIKFAARADLHHLRQFIAGRQADAPQEALQVLDIVLRELANQRYVSIGRSFYSPDIRRPQRLGDGLQSWCGFYQSIRPTQMGLSLNIDMSSTAFIEPLPVIEFVAQILGKDVISRPLSDANRIKIKKALRGVKVEVTHRGNVRRKYRISGLTTQPTHELIFPIDEQMNMKSVVEYFKEMYGFTIQHPHLPCLQVGNQKKANYLPMEACKIVEGQRYTKRLNEKQITSLLKVTCQRPREQEMDILQTVHQNGYEQDPYAKEFGINISEKLTSVEARVLPAPWLKYHDTGKEKECLPQVGQWNMVNKKVINGCKVSHWACINFSRSVPENTARGFCQELAQMCQISGMEFNSEPVMPLYSARPDQVVKALKNVYNIALNKLKGKELELLLAILPDNNGPLYGDIKRICETDLGLITQCCLTKHVFKISKQYLANVSLKINVKMGGRNTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFANNHKDRSSMDKSGNILPGTVVDSKICHPTEFDFYLCSHAGIQGTSRPAHYHVLWDENNFTADEMQTLTNNLCYTYARCTRSVSVVPPAYYAHLAAFRARFYMEPEMSENQTSKSSNSTNGVSVKPLPAVKEKVKRVMFYC

SEQ ID NO: 853 - DNA, 3374 bp, Oryza sativa
agtcagtagtactcgagtatctccccattcctcctcgcgtaaaagaaaatctcccgtctcgtcgtctccgttccttgcgccatctcgcggctgaacaggggtcgcgagcagagcaggggatcctgctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagggctgccttttagtacgccagtcatttttccacaacaatcctaataactttgttgacctgggtggtggtgtgatgggctgtcgaggattccattcaagtttccgtggcacacagagtggactttctctgaatatcgatgtttcgacaactatgattgttaaacctggtcctgttatcgattttcttcttgccaaccagaaagttgatcaccctgacagaattgattggcaaaaggccaagcgtgctctcaagaacttgaggataagaaccacccctgtgaattcagaattcaagatcattggtttgagtgacagaaattgcaacgaacagatgttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagagctatgctctcttattccactacaaagatacaccaaagctttgtcaacactgcaaaggtcctcccttgttgagaaatccagacagaagccccaggaaagaatgtcagtccttaatgatgcacttcgacatagtaattatgattctgatcccatgttgagggcatctggcatttcaattgcccaaaattttactcaagttgaaggaagggtcctgcaacccccaaagctgaaagctggcaatggtgaagatatattcccacgcaatggtcggtggaacttcaacaataagaaactgattcagacctgttctgtcgataagtgggcagtagttaatttctctgcacgctgtgatgtgcgaaatcttatccgggacctcataagaaatgcatctgcgaaggggattcaaatggccgaaccttttgatgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggtccttggaagaggaagtgtcttgctgaattcggtattgtcacacaatgccttgctccacaaagagtcaatgatcagtacctactcaatttgctattgaagataaatgccaagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtggttagctctcgccaatggcctctcatctctaaatacagagcatcggtgcacactcagtcacctaagctagaaatgatgtcttccttgtttaagccacgaggaactgaagatgatggcctcattcgggaatcgctgattgacttctacactagttctggaaaacggaaaccggatcatgttatcgttttcagggatggagttagtgaaagccagtttactcaggtcattaacattgagcttgatcagatcattgaggcatgcaaatttctcgatgagaagtggtcaccaaagttcacagtgattgttgctcagaagaatcatcataccaaattttttcagtctggatctccagataatgttccgccaggtactgttgtggacaaacaagtgtgccatccaaggaattatgacttctacatgtgtgctcatgctggaatgattggaacgacgaggccaacacattatcatgttctgcacgatgagataggtttctcccctgatgatctgcaggagctagtgcactcactctcttatgtgtatcagagaagcacaacagccatatcagttgttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagtatctgatctgttcgaggttggggatgaatgaccaaggaaatctttccttgtggttatcatgacatcattgatatcctcaggattactcatcatcagtttactgacgggtaaaatataactggcatggatgaaattatgacgattttcttcccacaac

SEQ ID NO: 854 - DNA, 3541 bp, Oryza sativa
ggtgagcatccgcatcctctttctgattcatctctctctctcccaccgggactacttttttctggaatttgcttgcgttcgtcaatcctagcttctcttctaaatcttggaagaagctcttctcttcttttcagcgccataaccttaatacaagtaacaatctgtttgttccccaaaaagtttgagggtttaactgaacccctatgtctcaagttggatccgctcctgtaacgtttcccccttaaaaattttttttgggggttcaactaaaccctaggtttattggtatctgctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagggctgccttttagtacgccagtcatttttccacaacaatcctaataactttgttgacctgggtggtggtgtgatgggctgtcgaggattccattcaagtttccgtggcacacagagtggactttctctgaatatcgatgtttcgacaactatgattgttaaacctggtcctgttatcgattttcttcttgccaaccagaaagttgatcaccctgacagaattgattggcaaaaggccaagcgtgctctcaagaacttgaggataagaaccacccctgtgaattcagaattcaagatcattggtttgagtgacagaaattgcaacgaacagatgttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagagctatgctctcttattccactacaaagatacaccaaagctttgtcaacactgcaaaggtcctcccttgttgagaaatccagacagaagccccaggaaagaatgtcagtccttaatgatgcacttcgacatagtaattatgattctgatcccatgttgagggcatctggcatttcaattgcccaaaattttactcaagttgaaggaagggtcctgcaacccccaaagctgaaagctggcaatggtgaagatatattcccacgcaatggtcggtggaacttcaacaataagaaactgattcagacctgttctgtcgataagtgggcagtagttaatttctctgcacgctgtgatgtgcgaaatcttatccgggacctcataagaaatgcatctgcgaaggggattcaaatggccgaaccttttgatgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggtccttggaagaggaagtgtcttgctgaattcggtattgtcacacaatgccttgctccacaaagagtcaatgatcagtacctactcaatttgctattgaagataaatgccaagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtggttagctctcgccaatggcctctcatctctaaatacagagcatcggtgcacactcagtcacctaagctagaaatgatgtcttccttgtttaagccacgaggaactgaagatgatggcctcattcgggaatcgctgattgacttctacactagttctggaaaacggaaaccggatcatgttatcgttttcagggatggagttagtgaaagccagtttactcaggtcattaacattgagcttgatcagatcattgaggcatgcaaatttctcgatgagaagtggtcaccaaagttcacagtgattgttgctcagaagaatcatcataccaaattttttcagtctggatctccagataatgttccgccaggtactgttgtggacaaacaagtgtgccatccaaggaattatgacttctacatgtgtgctcatgctggaatgattggaacgacgaggccaacacattatcatgttctgcacgatgagataggtttctcccctgatgatctgcaggagctagtgcactcactctcttatgtgtatcagagaagcacaacagccatatcagttgttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagtatctgatctgttcgaggttggggatgaatgaccaaggaaatctttccttgtggttatcatgacatcattgatatcctcaggattactcatcatcagtttactgacgggtaaaatataactggcatggatgaaattatgacgattttcttcccacaac

SEQ ID NO: 855 - DNA, 3128 bp, Oryza sativa
aagagagagagagagagtgtgtgtggagaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctctgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 856 - DNA, 3096 bp, Oryza sativa
gaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctctgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 857 - DNA, 3101 bp, Oryza sativa
gaggcgttcgagtttcgagaggagggaggggggacaaggaggaggagcgcaccaccctctcggagaggtcgcctccgttcttgcatcgttttctttggtaaggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctctgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 858 - DNA, 3105 bp, Oryza sativa
gtgtgtggagaggcgaggcgttcgagtttcgagaggagggaggggggacaaggaggaggagcgcaccaccctctcggagaggtcgcctccgttcttgcatcgttttctttgggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctctgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 859 - DNA, 3008 bp, Oryza sativa
acttatttttttacttttcggtgaagcccgggaaaaagggcgctccatttcggagatttcgcacttcccaccccttcccttcgcttcctccctccctcgcctccgcctcatcgccgattcaaccgattcgccatcgccccccacctcgccgccgtcgccgccgccgcctcgtaaaccggtgggattttgcggggaggagggagtttggtgcgggagaagggggcggaggagtgggtggttttgttttttttttttttgtattttgtttttgtgtgtgagagaggggggaagggggcaatggagatggacacatcgccatcgtcttcggcgccgtcgtcgccggcggcgtcgtcggactccatcgacctcaacttcctgccgttcctcaagagggagcccaagtcggagccggcttcaccggagcgagggcctctgccgctgccggcagcggcaccgccgcctccacctccgccgccgcccccaccaccgccaccgcaggtgcaggcggcgacggtggcaactccggtgccggcgacgcccgacctctcggcggcggcggtgatgacgccgctgcagtcgctgccgccgaaccccgaggaggagacgctcctggcggagtactaccggctcgcgacgctatacctgtcgtcggcgggggcggccggcgtaatcgtgccggcggcggcgccggaggcctccgcgggggcggtggcgcagcccgggtcggggtccggcgcgaagaagcggcggccgcggtcgtcggagctggtgcgggtgtcctcgctgagcgtgcaggaccagatctacttccgggacctggtgcgccgggcgcgcatcacgttcgagtctctccgcgggatcctgctgcgggacgacgagcgcgcggaggtgctcggcctcacgggcgtccccgggttcggcgccgtcgaccgccgccgcgtccgcgccgacctgcgtgccgcggcgctgatgggggaccgagacctgtggctcaaccgcgaccgccgaatcgtggggccgatcccggggatctcggttggggacgccttcttcttccgcatggagctttgcgtgctagggctacacggccaggtgcaggctgggatcgactttgtcacggctgggcagtcttcctcaggggagcccatagccacatctatcatcgtgtccggtgggtatgaagacgatgacgatcgcggcgatgtacttgtgtacacaggacatggtggtcgtgaccccaacctccacaagcattgtgttgatcagaagcttgagggtggcaaccttgccctcgagcgtagcatggcctatggtattgagatccgcgtgatccgtgctgtcaagtccaagcgcagccccgtcggcaaggtatacttctatgatggcctctataaggttgttgactactggcttgaccgtgggaagtctggcttcggtgtttacaagtacaaaatgctgcgcatcgaggggcaggagtcgatgggctctgtaaattttcgactagccgaacagcttaaggtcaatgccctgactttccggccaacagggtatttgggctttgatatttccatgggtcgagagatcatgccggttgcactgtacaatgatgttgatgatgatcgtgacccacttttatttgagtatctggcgcggccaatatttccgtcctctgcagtccaagggaagtttgctgagggtggtggcgggtgtgagtgcactgagaattgctcaattggatgttactgtgcacagaggaatggcggtgagtttgcatatgacaagctcggtgctcttttacggggcaaaccactggtatatgagtgtgggccatattgccggtgcccacctagttgccccaacagggttagtcagaaggggcttaggaatcggcttgaggtattccggtcaagggagactgggtggggtgttcggtctttggatctcattaaggctggaaccttcatctgtgagtttagtgggatagtgctcactcatcaacagtcagagattatggctgcgaatggtgattgcttggtgcggccaagcaggttccctccaaggtggttagattggggtgatgtctctgatgtctatccagagtatgtggcaccaaacaatccagctgttcctgacttgaaattttcaattgatgtgtcaagggcaaggaatgtggcttgttatttcagccatagttgcagtccaaatgtgtttgtccagtttgtgctgtttgaccattacaacgcagcttatcctcacctcatgatctttgccatggagaacattccaccattgagggagctaagcattgactatggaatgattgatgaatgggtgggaaagttaaccatgtagtcaggctgtctactagaaggcaatactcagtttatcttcctttgttttgatgctttcataatccttctcatggagatttttgaggtgattgctgacaacaagtttctctgatggcgaataacagaagcttgcatatgggatgatgtttcaagccttcccatgaggaaggcaaagtcacagctcattgtcatccactaggcatcaaccgtccgttgtatatttttgcatggtagctgcagtgccccgtggctgattccctctcacccttgaagcttgatgcttgcttttgtaggaagcttgttttgcgcagcaagcaccgagtttcatacttgacctctgtttttctttttttttcccttcaattgctacgagaactccatatgtacatatatctgtacattacatgacttcaaaatgtgtcccacttctgtctgtaaatgctggttggccatgtcttgaatggtagggtagctcatagatttggagctcttacagaggctagtcctggagaggcattctgtccaggacatatatatgccgtactgatggttttgctagctattcatatattcaactgtcgggctactggtgtcaatgtcaccctggtatctacaagtgcaacctgttgaggtggtcattgtagagatttcatcagc

SEQ ID NO: 860 - DNA, 2181 bp, Oryza sativa
gtccgcttcggcttctctctctctctctctctctctcctcgaaaaccccaacacacacaacgcgaaccccactccgcgatggcgtccgccggcgatcgccgcggcggcggggggcctcccggctccggcgacgactccgggggtggttgggagactgttgagaagagggtaaagaaaccagcgcaacaagttgggaaggggcaatggggacaatggaattctccaaatgctgcacctgcacctactgcaccacggagtggctctggagcttttcatcattctggaaacactttggttcgacattctgatcgtaggccagcaagaggcactcctaggccaccaccacaaaacaggtctatagaggcagaactgcaagcaccgcacggagttgtgactgcacctctggcaaatggttggcagtggggagccaggtcttgcccacctggtactgaaagcaaggagggtggtcttcctttgtctggttgtgatcctgaaacagacaatgctgaaggttatgacacatcggacgatgataatgatgatgatatgagtgacgatttgagtgatgactatgattctgatgcaagtgagaaaagttttgagactcggaaaaatcacaagttgttcaaaggtttcttcgaagtcctggaggcgttaagtgtagaacagttaaatgaaccaactaggcaatggcattgcccagcatgcaaaaatggacctggtgcaattgactggtacaaagggctacaacctttgatgactcatgccaaaacaaagggttctataaaggtcaagcgtcacagagaattggctagtttattggaagaagagctatctcgcaggggaacttcagtggtaccatctggcgaacaatttaggaaatggaaaggattgcgggaaagcactgatcgtgagattgtttggccaccaatggtggttgttatgaacactgtattggaacaagatgaggatgataagtggaaaggtatggggaaccaagagctaattgattatttcagtgaatatgctgcaagcaaagcacgccatgcctatggtccaaatgggcaccgtggcatgagtgtgctaatctttgacagctcggctgtgggctatatggaagcagaacgtttgcatgatcactttgttcgtcaaagaacagacaggaatacatggaacagtgctcacaaggttacattcttacctggtgggaaaaggcagctgtatggtttcttagctacaaaagatgacatggagacattcaatagacattgccacggaaaatcccgtttgaaatatgagatgagatcttataatgagatggtggttacccaaatgaagcagatgagcgaagacaaccagcaactgaattacctgaagaacaaaatggttaagaaagagcagcactctaaattagtagaggatacattgagtgttgttacccagaaacttagggagacaatggaagagaatactattgtacgaaataaagccaaagaaaagcacttggagtatgagaaagagatgaagtaccaggaggaatttttccatgatcaaatcgaaaaaattcacaaggccacagaggagaaagaaatcaagtttgagaagttgctgcaagaggagcgagcaaaggctagacaaagtgatgttgactctggaagtactgaagatcgcaggcaaaggaaggaaaagattcagaacttcatagactgccaggtgaaggatgttgaggaatttgaagccgaacgagacaaactgatcaaattgcatgaagagaagaaggtgaagctcaagaaggagtacctggcgaaggaatttgagcttgagaaggagctggacacagccctcacttccctgatggataaacacaagccggacatcttcaaatcctccacctcgccttcgacatgaagaactgcggcttaccatacatttcctgctcatctacaatagctaagactcccatttcctaagtacccgtaaaacttctagcgatgcgaaagcatcattctgtttgggtggatgcatgcctttggaaggaaacctgaaccagttccgtattatatggagtactatcagtttatggttgctgatgaactgatgactgtgcgctgcgcttttacagcaagcgtggaaatcgaatatatatctagtttatctcatcattctgctctgcgttgcatc

SEQ ID NO: 861 - DNA, 2720 bp, Oryza sativa
gtttccacaccaccattggtcaagtcaagctgcgcgtccaatcccacaactcactgacgcgtgggcccgggtcgtcctcactactactactgtgcagtgcagccagcactagtgctctcctgctctcctctgcttctcttctcctctcctctcctcaccgggagagtggagaccctcgagatgcccggcggtcgccgcggcggcggcgggcgtcctggctccggcagcagcagcaacggcggaggctccgggtatagttgggttgagaagaagtcgaagaaatcggagaaatcagttggaaagggacaatgcgcaccatgtacttcttcaaatgctgcacctaaacctgctatggcgtggcaagcacggagtggcaatggatctttacaccctcctggaaatggtcgggttcaacattctgatcataggcctgctgccagaggcagtcctaggtcactgccacaaaataagcatacagaaacaaaattgcaagcaccgtgtccagttgtgactgcacctcttgcaaatggtttgcagtgggtacccaagtctcgctcatctggttctgagagcaatatggatgatgctcctacatcaggttctgaccctgaaatggacaatggtgcaacacacccagttgtgactgcaactcttgcaaatggcttgcagtgggtgcccaggtctcgctcatctgactctcaaagcaacaaggatgatgctcctacagctagttctgaccctgaaacggacaatgttgcaccacacccagttgtaagtgcacctgttgcaaatggcttgcagtgggtacccagatctcactcatctggctctgaaatggacaatggtgaggattatgattcatatgacgatgattctgatgatgatatggttgatgataccagtggtgactttgattctaaggcatctgagaaaaattttgagactcgaaaaaggcacaagctgttgaaaagcatttttgaacttctggagaagttaagtgttgaacagataaatgaaaagactaggcaatggcattgtccagcatgcaaaaatgtacgtggtggagttacctggtacaaagggttacagcctttgatgaatcatgctagaacaaagggttctaagagggttaagcttcacagagaattggctgcattactggaagaggagctgtatcgtacgggaatttcaatggcatcatctggcgagttctttggaatctggaaaggattgcgagaaaacactgatcgtcctatagtatggcccccagtggttattattatgaacactcgattggaacaagataaggatggcaagtggaaaggtatgggaaacaaagagctccttagttatttcagtaaatatcacgtgaaggaagcatgccatgcttatggcccagatgggcacagtggcatgagtgcgctaatatttgaaggatctgccgtggcctataaggaggcagaacggttgcataatcactttgttgatcaaagaacagacaagtatgcgtggttgaatcataggatcgtcatacctggtgggaaaaggcaactgtatggtttcttagctgaaaaagaagacctggaggcgttcaatagacatcatggaaaagactatttgaaatacgagatgaaatcttataacgagatggtggttacccaattgaagcagatgagtgaagacaaccaacaactgaattatgtgaagaatgagatggttaagacagagcgacattctaaagaagtagaagaagccttgggtgttgagacccagaaacttcagggagcaattgaagataatattattttgaagagaaaaaccaaggagatgctctcagagtgcgtggaacagatggagtttaatgcgaaattttatcatgaacaaattgaaagacttcgcaaggacaccgaggagaaagagaatgagtttgagaggttgctgcaggaggagctagcaagagctatagagtgtgatgttgactctgaaactacagaaaattgcaagctaagggaggaacagatacaaagaatcatagattgccaggtgaaggatgcggaggagtttgatgctgaacaagatgaattgatcaaaacacacgaagagaagaaggcgaacgtcaagatggagtatatggcaaaggatgttgagctcgaggaggagctttatgccgctctcacaagtctgatggagaaacacaagccggacatcttccaaccgtccagcccttgaagagctgcaggcttgcagctcaccatatatatgccctgctcacaataatctcaagaggtccctctcccaaatgaacttcaatttacatgccgataaattgcttgaaatgctcagaaactctcccgagtggcgtctctgggcaattgtgttgcacccccaatttggtgttttgatctgcaatttttatgcatctgcaaaggtcaatttgattgagttgacaagaatacctgttgctcaactcaaagatgatgtgctattcttgtcaaacatataactctacacggttttgatttcacttgcaagtttgtgaaaataaaagtaaaacagatggttttactttgcaagtaaaagaatttcggaactgccaagtccgtccctaatatttctagagattcagaaacatcacatgtttttgggttactgcaagcatggtttgaagtttggacttcattttggaatgaaaaatctgttcgattgtcatgtatggaagc

SEQ ID NO: 862 - DNA, 4046 bp, Oryza sativa
tcttcgttggtgtcccctcgcttaaacccctccgaaatttatttactcatcaaaaatttaataaccgaatccgattgatcttcccctctctctctctctctcactcctcccagctcccacccaaccacccaagccatgcgatcgccgcgcggcggggcggccgcgcagccgtcggggcggcgcggcgacacgacggcggcggcggcgggcgatctggtgacgacgcaggtcagccttggcggcttcgacgccggcgtcgccgcgggggacctcgccgacttcctggagcacgaggtcggcctggtctggcgctgccgcgtcaagacctcctggacgccgccggactcctacccggacttcgccctccccaccgcccccgcctccgcctcggccgcggccgcgccgccgcggtacgaccgggtgcccccgcacgcgtttgtccacttcgcgcgcccggagggggcgcgccgcgccgcggacctcgcgggggagaccaggctcatcctgagggggaagcccctgcgcgtcgcgtccgcgccggacagctcgctccgcgtgtcccgccgcagcagcatcgcgccgttccggttccccgacgtgcgcctcgaggtcggggcgctcccgtcgcccggcgcgttcctcgccgcctggcgcgggccggacgccgggctcgacctctccgtcgaccccttcgacgggtgctgccgcctcgtgttcacccgcgacaccgccttcacgttcccgggcttccgcgaggtcgccgccatacgctgcgacgtcaagctggagttccccgtgcgcgacgtcctggaggtccgcctgtaccgcctcgactgctcgctgctcctccgcctcgccgccgcgccgctggtgcactaccgcaccgccgacgacgacttccacgagccggtccccttcgacctgctcgacgacgacgacccgtggatacggaccacggacatcaccccgagcggcgccatcgggcggtgcggggtgtacaggatctccttctcggcgcgattctggcccaagatggaccgcgcgctggactacatgagggagaggagggtggcgatcgtcgattgcggcggcggatgggggccgcggcgggggctcacagtgcgcgacgagctggagttcggggagccaatgcaggacgtcttcttctgcctgcagcacgccgaggggctcaagttcccgctcctcttcatggtgaacgcgttggtgcacaagggaatcatcaaccagcaccagctcacgcctgaattcttcagcctgctggggagaagcgaggagaacgtcaatgtggctgcattgagggatttctggggggacaagttcccagtgtttgatgcgtgcgggaggctgaagaaggcactgaatcgggtggccaggaaccccaaacttctctgcagcaaggtcggggatgaccacgcggaggtgcggaggctggtgatcacgcccaccagggcttattgtctgcctccagaagtggagcgctcaaaccgtgttcttcggcattaccatgaggtggctgacaggtttttgagggtcacttttatggacgagggtatgcaggtgctgaacaacaatgtgctcaactccttcactgcaccaattgtcaaagacttgatgtcgaattttttccagcagaagacaacggtgtacaagcgtgtcaggatgttgttgacggagggtttccacatgtgtggaaggaagtactcatttctcgcattctcatcgaaccagttaagggacaagtcagcttggttctttgccgaggacagaaagacaacggtggaagcaattaggaagtggatgggacggttcacaagtaagaatgttgcgaagcatgctgctcgaatggggcagtgcttctcatccacatatgcaactgtgacaatgcggccggatgaggttgatgagagttttgatgatgttgtgcataatgagtacattttctccgatggaattggcaaaattaccccagatcttgcattggaagttgccgagaggctgcagctgacagataacccgccatctgcttatcagatcaggtttgctggcttcaagggtgtcatagctgtctggcaaggacatggtgatgggacacggcttttcctgaggccaagcatgaggaagtttgagtctaaccatttggtgttagaggtggtctcctggacaaagttccagccaggattcttaaatcgacagattataatattgctatcctcactgaatgtcccagattctatcttttggcaaatgcaagagaccatgctttctaacctcaacaatattctatcagacagagatgttgcttttgaggttttaacaacttcatgtgctgatgatggaaacactgcagcattgatgctcagtgctggctttgaacctagaactgaaccacacttgaaagcaatgctcttggctataaggtctgcacaattgcaggatcttttggaaaaagcaaggatatttgtgccaaagggaaggtggttgatgggctgtcttgatgagcttggggttcttgagcaagggcagtgctttattcgggcaacagttccatcattgaatagttattttgttaagcatgggtcaagattttcatcaacagataaaaacacagaggtcattttgggtactgtggtaatagcaaagaatccctgtcttcatccaggggatgtccgcatccttgaagcagttgatgtgcccgaactgcatcatctggttgattgtttggtgttcccccagaaaggtgagaggccacatgctaacgaggcatctgggagcgatcttgatggggatctctactttgtgacatgggatgagaaacttatacctccaggcaagaagagctggaaccctatggactactccccacctgaagcaaaacaacttccgcgccaagtatctcaacatgatatcattgatttcttcttaaagaacatgataagtgagaatcttggtaggatctgtaatgctcatgttgttcatgctgatcttagcgagtatggtgcaatggatgagaagtgtattcacttagctgagctagcagcaactgccgtggacttccccaagactggcaaacttgcgataatgccaccacaccttaaaccaaaagtctaccctgacttcatgggaaaggaagatggacaatcttataaatcagaaaagattcttggaaggctttatcgttcaatccaagaggcctccaatggtgatgtggtgtcacaagaggtttgcactccaaatgatctgccttatgacatagatctggaagttcctggtgcatcagatttcctcgcgagtgcttggcaatgcaagtgttcatacgacgcgcagctgagtgcgctgctcagtcagtacagggtccgcactgaagctgaacttgtgacagggcacataacgttccttgttaagaacagcagcaagaagcaaggcgacataaaggacaggctgaagactgcttactctgcactacgcaaggagttcaaaagtacctttgagagcatagcatcggatcaatgcgagattggtgatgacgagaagaatctgctgtacgagatgaaggcctctgcctggtaccaggtgacctatcaccccaaatgggtggagaagtcgaggggcattctgggcccagatggtgaggaaataccggcaagccttagctttgcatggatcccggtggattacttggcgcggataaagctaaggtgccatggtaaagtgagagttgaaggccaaaagcctgttgaaaggcttgcagcatacatctccgagaggatatgatgaaacaatgcaaaggtcgcagtaagaccactctgccattcgtaatgccggttcaaagggcatgcgtacaaaatatctgagtttttttttcttttcatttttgttcacttcactgaacttgatctcccgaatgtttcagtgtgcttttgttccttcttacatgcccctcaagcctgaaaaactgtacgtttcagttgagggctgtctatattatgaaatgcacaaatatacgctgcctgcagcttttggcaata

SEQ ID NO: 863 - DNA, 3931 bp, Oryza sativa
atgccgacggcggcggcggcggccacggcgtcgctgcgggtatccaacatcccgccatcggccgtcgccgcggagctgctcgccttcttcgactccgccgtcgccgtcgccggcggcgcgttcgcctgcgagatcgcggcggcccaccgcgggtggctcagccggggccacggcaccgtccagttcggctccgccgcggcggccgctgccgccgcgggcctcgcctcctccggccgcctcccccgcttcctcggcgccctcctctccgtctccccttcccccgtcgacctcctcccgcgcgcgtccgacctctccctccgcgcggccggcgcgggcctcgtggtgggcgaccgcgtcgccgagcgcgtgttcgaggccgccgacgcgtgggacggcgtgcgcgccgaggtcatcccggggaagcggcgggtggacctgtacctggagcacgattcccagaggtacaagctcgaggtgctcttcgaggacatgaaggattgcctcgggtgcaccctggacgggatgggcgccatcttgctgcagctcaattatgcaccaagaatacacactgcaatttctgggcctgcagttaattcaaggtttatggatgaccgctttcatgcatgcaaggaggatgctaaattttcctgggtcagggcacttgattttacacccaattattcttttgggaggtgctctactcttgtccttaaactgggtaaaagtgcattggtgtctgatattctcaaaagtttacctttctcaggaaatttaggggaattgactatgaattcaatggatggtgttggtgcctcctccaatgtggttccccttgttcattgtccgagggactattcagtgccttatgaagttctgtttcgtctgaactctctcatgcatatggggaagatagtcgccaagcatgttaatgccgatctgtttaaagcccttcaagaactaccggttgatgtctcaaggagaatttttgagaaaatgcacaaattagagtctacctgctacgggcctttacaatttatccaacaggaggcttatagcatgaagagaagccataatgttttgctctccaatgaaggtgaaggtgaaggtgaaagaaaattgatgaagtgttatagagttaacataactccctccaaaatattctgctttggacctgaagaagaggttacaaattatgtggttaagcatcattctgcatatgcttctgactttgtgagagttacttttgttgatgaagattggagtaagctttcttctaatgcaatctcagctagaattgaacaaggtttcttttctaagcctttcaaaactggtctatattatcggattctctccattctaaaaaaaggattttccattggtccaaagaactttgaatttttggccttctcagcaagtcaacttcggggaaattctgtttggatgtttgcttctaatgcttccttgaatgctggaggtataagaagatggatgggccactttgagaatatccgttcagtttctaaatgtgcagctagaatgggtcagctgttcagctcctccaggcaaacatttgaagtcttacgatgggatgtggaagtgattccagatattgagatcacaactgatggctccaaatacatattttctgatggtattgggaagatatctttgagatttgccaagcgagttgcacaccacgttggattagatcctactaaccttccttcagcttttcaaataaggtatggtggctacaaaggagtcattgccattgatcctatgtcctctattgatctttctctgcgtcctagtatgaagaaatttgagtctgagagcaggatgttgaacattacaagttggagcaagtctcagccatgctatgtgaatcgtgaaattatttctcttctctcaacattgggtataagggatgaaatttttgttgcaatgcaacaagatgagatgcgtgaaacagaagaaatgctaaccaacaaagaagttgctttgtcagtcctagggaaacttggtggttctgaaacaaagacagcagtgaagatgttgctgcaaggttatgagcctagttcagagccttacctgtcaatgattcttaaggcccatcaggagaataggcttactgacattagaactagatgtaaaatacatgttccaaaaggccgtgttcttattggttgtttggatgaaacaggtgtattagaatatggtcaggtttacattcgaattacaaagaacagcaaagaacaaaaggacagtaatcaatcatatttttataatgatgacgggaaaacagccacagttgttggaaaagttgcaatcacaaaaaatccgtgtctccatcctggtgatatccgagtacttgaagccatctatgaccctgatttggtgggcatggttgattgtcttgtcttccctcaaagaggagaaaggcctcatccaaacgaatgctcggggggagatttggacggcgacctctattttattacttgggatgacaaacttattccagagaaagttgatacacctatggactacacagcaacaaggccgcgcataatggatcatgttgttacactcgaggaaattcagaagcactttgttgattacatgataaatgactcgcttggtgccatctcaactgcccacttgattcacgcggaccgttcgccactgaaagctcggagtcccgagtgcctccagctggcaactctgcattccatggcagttgacttcgccaagacgggagctccagctgaaatgccgcgaacattgaggccgagggagtaccccgacttcatggaacggtgggagaagccgatgtacatctccaatggtgttcttggcaagctctaccgatcagcgatgggtcacatggagaaatcaggagattcaggagctctctcatcatcctcagcacaaccaagccccacatacgatcctgacctcgaggtccctggctctgacgaattcctgcaagctgcagaggagtactacgagctgtacgaggagaaactgaccacgctgatgaactactaccgtgcggagctcgaggacgagatcctgacgggcaacatccggaacaagatgctgtacctgaagagggacaacaagaggtacttcgagatgaaggaccggatcgtcgccgccgtcgacgccctgcacagggaggcgaggggctggctgctgagctccaggaaggaagaggacgcgtcgcggatggcgtcggcgtggtaccgcgtgacgtaccacccagaccgccgccgcgggaagcggttctggagcttcccgtggatcgcctgcgacaacctgctggcgatcaaggcgtcgagccagctcaggcggcggcggcagaaggacgatgactccaccgcggtggtgcagatggactgcagcgcctgatgtggcagaggattctctgactttgagtgactgacatgtgggcctgctggataagggatccatgggtcagtgacaagttagagggaaataaattagaggttctctgacgcgccgtcctaagtgaactttcaactgcacagttcattgctgtgcgcctgtgcctgtacgctgtacaaatctggttcgactaatcttagctgagctgaacagcagagctccggctcgcaacttggaagaggaaagagtttgatgatgaacacctacgtagagtaaaagttcctcttcctaataaaagagtcttagtgctgatctaccggtaaggtggaggcttccatttcttgttttctgcgaaggaaagaaacttagggtgtgtttagttcacacaaaaattgaaagtttaattgaaagtgaacgatgtaacgaaaaagttggaagttcatgtgtgtaggaaagttttaatgtgatgaaaaggttactccctccgtcccataacataagggattttgagtttttgtttgca

SEQ ID NO: 864 - DNA, 4047 bp, Oryza sativa
atgtgggatgagaaggaaaggccccgggtcttctgtctagcaccacaagatggagaagctgtctggtggttagcgatggaagatcctgaaattactggtcagcagtcaccaaatgccacaagtattgtgacggatctcatggatttggatgacattattgttgagggcaatgaggtacagtttgctatggatgtggatttgagagcaataccatctctgaaagatggagggcacacagacccactggtacaaatcccaggtgacatgtctcatatggatgtggatttgagagtgataccatctctgaaagatggagggcatgcagacccaccagtacaagtcccagttgacaagaggattgcaagcctagagaagctctgtaaagaagcatcaagatcatttttcagggaaactaggctagttagccatcagataaactcctacaatgattttgtctctcatgggctccaaaagatgtttgattctctcgatgaagttactgtcgagcctgactatgatccttcaaagaaagtaggcccctggaggcacgcgaccatcaagtttggtcgagtggagcttgaggagccggtgttttgggtcgacaactgtgatcttgatgtggaaacactcaaactgaagcctaaacatgctcgcctccagaagatgacatactcttcaaagatgaaagtagaaatgactgttcaggtctattcactccacaaaagcgacaaagctaaaactggcgaggacccatatatacaaagaaaagatataatgaaagagactaaatgggtcactattggcaagttacctgtcatggaaagcgaatgcgagtatgattttggtggatattttcttatcaagggaatggaaaaggtattcgttgctgaagagcagagatgcctctccaggatttggatcaatgacagccccacctgggaggcttgttaccaacggtctcaaatccgacgagaaaagatctctataaaacctgttcagtctaatgatggtttcagaaaagtcattaacctgtactttttgggtgcaactataccaatctggataatgttttttgcactaggtgtatcatcagacaaagaagcttttgatattattgacatacaagaatgtgatgcttccatggccaacataatatcagctactataactgaatctcatgagcagtgcgaaggctttcagagagaagggagagccagtgaatatattgataagttgatcaggaatacaaagtttccaccaaaaggatcctttgatgagtatattggtaggcatatgtttcctgatgttagtgggaataggagcaaagcactcttcttgggatacatggtgagatgtcttctattggcttcctctggcaatcggaagagtgataatagggatgatttccgcaacaagaggctggatttggcatgtgaattgctccagagagagctatgggtacatattatgcatgcccagaaacgtatggtcaaggtcatgcagagacatttgagtggtgatggtgacctacaacctcttgagtgttatgtccatgcatcaattgttaccaatggtctcaaccgtgccttctccactggttcctggtgccatccatttaataaaagagagaggtgttcagggattgttgcaacccttaggagaacaaatcctcttcaaatgatgtctgacatgaggaagacacgacaatgggttgcatatgctggaaaggctggagatgctagatatccgaatccatcatattggggaaagctatgtttcttgtccactcctgatggtgaaaagtgtggatttgtgaaaaatcttgccattactgctatcgttagttgtttggcaagggagccctcggttgacgcacttgtttcttgtgggatgaagaaactggatgaactgcttctacaagagatcagcgggaaagacagaatcttcttgaatggaaacttggttggagtttgtgcagactcagtcgagtttgttttgcacttaaggagcatgagacgcaggaagcaaattgatgcacaggtggagatcaaaagggacaagcaaaacaaagaagttcgtatattttccgatccaggaaggattctaagacctcttcttattgtcgaaaatctacgaaacatcatgaatcgaaagaatggatcatactccttccaggaacttatggatcaaaatataattgagctgattggtgttgaagaagaggaggatatccggtgtgcttatggaattaggcatctctttgcaggggacgaagaaaagaatttctcattctatactcattgtgaacttgacccttctttcttgctaggattgagttgcagtatcattccctttgccaaccatgatactgctaagagaattctaatgcaagctgaaaagatatcgcaacaggctattggctactccactacgaatcctctctttagagttgatacacattcccatcagctctattatccacagagacctctgttcaaaactgtagctgctgattgtcttggtaagagagactatacatctggaagcaaacatgactttgccagaccagagtatttcaatggccaaaatgcaatagtctcaatcagtgtccatcagggatttaaccaagaggattctttggtattgaatagggcctctttagagcgtggcatgtttcgaacacaacattttaagagctataaagcactgatagaaaacaaagagatcaccaaacgattaaaacacaaggaaaatatcaattttggaaaaactcctagcaagaaaggcctggttgacagtttagatattgatggcttaccatatattggagcaagtcttcagagtaatgacattatcattggaaaggtctcagactctggtgaagatcatagcatcaagctgctacatactgaaaaaggaatagtggagaaggttgttctttcagctactgatgatgggacaaattctgcgtttgttactctaagacagactcgctcgccacgcattggagacaagtttgccagcatgcatggccagaaaggagtcattggcttcttggattcccaggagaacttcccttttactcaccaaggcatagttcctgacattgtgatcaatccccatggctttccaactcgtcagactcccggccaacttcttgaagctgcactaggcaaaggaatcgccctcggcggtgccacccggtatgcgacaccgttcacaagtccatctgtggaagtgatcacagagcagctgcacaaggctgggttctccaggtggggaggggagagcgtgatcaacggccgcaccggcgagcgtgcggcgtcgccggtgttcaccggaccgacgttctaccagcggctccaccacatggccgaggacaaggtcaagttccggaacaccggcccggtgcacccgctgacgcggcagccggtggaggaccgccgccggtacggcggcgtcaagttcggcgagatggagcgcgactgcctcctcgcccacggcgccgccgccaacctccacgagcgcctcttcctcctcagcgacgtgtcgcgcctccacgtctgccgccgatgccagcgcgccgccgtcgtcgtgtcgcccgccgtcgccgccgacggcggcggcggccggaaggtgagggggccgtactgcaggttctgcaggtcggcggaggaggtggtgagggtgagcgtgccttatggcgccaagatcctctaccaggagctcttctccatgggcatctgcctcaagttcgacaccgagctcatctagagtagactctcagctttggacgggaaacatcatgatttattcttttaaaaatgggatttttatcattttttaagaacatttttaaggacattttagtctggtgaggagagttgacaatttactccattcattttatattataagacgctttggatttgtcgtaataagtctcttgaatgtcattaaaacctgtattgggatattatccaattggggcaattgtgttcttacccctactttcatatctaattgtgattttacccctcttttcta

SEQ ID NO: 865 - DNA, 4264 bp, Oryza sativa
gccagaacccttctcccccctcttcactctccccggaagcatcgctcgcacgcatcggacgccggaatccccgcctccggcgactagggtttcgccctccggcgacgcccctcctctccaccaggctattccctcgaagttatggaagagccatcaaaggacaatgggcaatcatcctgtgttgttgatcctgagctggaacctatgatgctggatgatgctagagagggagtatcccatacattggatgatgcaaatgggcattcttctatggatgttgacagaggatgccattctatggacaccacgagatcatctctgggtgatgatggtaaaggaaagcgcgactcatatgcccaaattccagtcgacatgagtattccaagcctagaaaagttctgcaaagaagcatcaaggtccttctttgatgagattggtctgatcagccatcagataaattcttataacgagtttgtctcacatgggctccaggaactttttgattctctgggggaagtgactgtggagcctagttatgatccttcaaatagaggaccaggtggctggagacatgctatcatcaagtttggaagagtgcaactagaagaaccagtattttggtctcatggatgtgatattgatgaacaatcgctcaaactgaagccaaggcatgctcgcctacagaatatgacatattcttccaaaatgaaagtggaagttcatttccaggtttactctatggagaagagtgacaaggctaaaacagggaatgataaatttggttacaagcgaaacattattaatgaaacatattatataaatattggccgccttccagttatggttatgtcaaatttatgttggctccacaaactcaaggaaagtgattgccaatttgattctggtggatactttttgatcaagggaatggagaaggtattcattgcgcaagagcaaaaatgtctgaccaggatttgggttgaggaccgtccttgctggatggtctctttcttgtctccaatcagaagaaggcgcatatatataaaactaattgattctgcaaataatgaagatgccagtggggggaagatcatttccatctcctttttgtatgcaaatatgccaatatggttgatgttttttgcactaggcatatcatcagataaggatatctttgatgttataaatatggaagactgtgatgcttgtgttatcaacacaattaccgcaactattaaagaatcagatgaattgtgtgaaggcttccgtaaatcagataaagcccggcagtatgttgacgaattgattaagaattcaaaatttcctcctgcagagccatttgatgattatattgctaaatacctcttccccagcataagtgggaaccggaacaaagcacttttcttaggttacatggtcaaatgccttttaatggctttcactgggaagcgcaaatgtgacaacaaggatgatttccggaacaagaggttggacctagctggtgaattgcttggaagagaactccgtgcgcatattaggcatgcagagagactcatggttaaggccttgcagagagatttaaatagtgagcgtgagttacaagaatttgatcattatctggatgcttcaattattaccaatggtctaaaccgtgccttctctactggttcttggtgccatccttacaaaagaaatgaaagatgcgcaggaattgttgcgacactaaggagaacaaatccgcttcagatgatctcggacttgaggaaaactcgccaacgagttgcttatgctgggaaagccggtgatgcaagatatccaaatccatcctactggggaaaattgtgttttatgtccactcctgatggtgaaaactgtggacttgtgaaaaatctagctgttacagctactgttagctccagagtagcaccgccattgattgacaggttcatttcttgtggaatgaataagctgcatgagattcctacagaggaggttcctagaatggataaaatcttcctgaatggggattgggtggggtcctgtagtgacccggcttcatttgtcttgcgtttaaggtgcatgagacgcagtggtctgatagatccacaggttgagataaaacgggacaagcaccaaagggaagttcgggtgttttctgatgcaggtcgaatcctcagaccgcttcttgtggttgaaaatctcaataaaattaggagaccgaagggcagttcatattcttttcagtggttaatgcaacaagaaataattgagtttattggcgttgaagaagaggaagatatacgaagtgcctggggcatcaggaacctatttgagagtgaagaagaggctcccatggtaaaaatgaataaagcagaggatgtcttcaatgttaagaggaagatcggaggggaggtttcaggttatacgcactgtgagctggatctttcttttctgctaggattaagttgtggtattatcccttttgcgaaccacaattttgctcggagggttctttaccaatctgaaaaacattcacagcaagctattggatactctacaacaaatccgcacatcagagttgataccctttcccatcaactttactatcctcagagaccccttttcaaaacagtgatagctgactgcattggtagatcagaatatacttttgggagaaaggatgactttgccagaccagagtatttcaatggccaaaatgcaatagtggcagtgaatgttcatcaggggtttaatcaagaagattccctggttatgaatagggcttctcttgagcggggtatgtttaggactgagcacttcaggaactataaggctgaagtagagaacaaaggtgggccaggtggcaacaaacgactaaaaatgaaggataagattgacttcggtaaaatgcaaagcaagagaggacgtgttgacaatcttgacgatgatggattaccatatgtcggtgcaagtcttcagagtggtgacattgtcattggaaaggtctcagaatctggtgaagatcatagtattaagctgaagcatactgaaaagggtatggtgcagagggtattactttcagctaatgatgaggggaagaactttgcagttgttactctaagacaggttcgatcaccttgccttggagataaattttccagcatgcatggccagaaaggtgtcgttggttttctagaatctcaggagaatttcccatttacttaccaaggaatagtaccagatattgtgataaatccacatgcatttcctacccgtcaaactccaggccagcttcttgaagctgctttggggaaaggaattgccctcggtggtacaatgagatatgctacaccattcacaacagcatcgtttgatgtgatcacagaccaattacacaaggctggattttcaagatggggagctgaaagtgttctcaatggccggactggtgaaaggatgcactcattgattttcatgggtcctactttttaccagaggctgatacacatggcagaagataaggtcaagttcaggaacacggggccagtgcaccccctaacacggcaacctgttgctgacaggaagaggtttgggggagtgaagtttggagaaatggagcgtgactgcctcctcgcccatggtgcagcagccaacctccatgagcggctcttcatgcttagtgacttctcgcagatgcacgtctgccagacgtgcgaacgtgtggcgaatgttatcatgaggcctgtcccaggaggaaagaagatccgggggccatactgtgggttctgccgctcttctgaaaacatagtaaggatcaatgtgccctacggcgcaaagctgctctatcaagagctattcagcatggggatctgccttagatttgagacggaagtctgctagaactccacatctactatcgactcaccatgtatatatatcctcgttgtcccttggagattctgttatgggcattagtgttgtagccacatgacttctcttccggttggacgatggcatagctaggaggggtgaatctgaagtcaggtgaaacctttcttttgctatttatttgggtgaagactcaattcccatcacctgcctttgatgtcctgtgaccaaccgatggcatagttagggatggggtgaatcagaggtcaactgaaaacccttttgctatagttcgatgtttcaccttggcactgtactatgcatatttggatgaaaactcatttcccatctcctgcttttgctgttctgtgatgaa

SEQ ID NO: 866 - DNA, 1500 bp, Oryza sativa
caaatgatatggagagtcaacggtctgatggagtcgaagaatctgaaaatggacctactgatgaagacaatggtgtgagcgatggtgaaaatgaggatgatttgggagctgatgcagaaaaatggaaacggcaagagatagatgagatggagtatgatgatgatgctgaaaaggaagagggttttgatatggatagtgaatctgaagaagataccaaatctaaacctgagagtgaagatcatcaagcaaaattagatgaagagttagaagagtctgaggaaggacatgtgctagattctagcaacaagggggaaaatttaaaagctaagcaagcaacagccagactcgaagatgaaatgaatgaagctgaggatgaaaaggcgcaagtgaccataaagttcaagaaaaacataaaatggactattcattatgaatcaacaggtttaaattttgaggttcactacgctttgcaagagcaacctcatattctgttagcccagattgctcagagaacagctaggtctgtttttgtcaaggcctgtaagaatattgatcgatgtgaagtgaataaaccaaagaagatagataataatacgataaatactcccatcactctacaaacagcaggggtgaactttgaagtattccataagttagtggactatctcgatatcaatgaggtcagatccaatgatatacacgctatgttgaacacatatggggtagaggctgcaagggcaaccatcattggggaagtgaagggcgtattcggtgcttatggtatccatgttgacatgaggcatctgaacttgattgcggatttcatgaccttcgacggcggttaccgaccgatgagcaggctagggatgggccagttcagcacctcgccatttggtaagatgacttttgagacggcaaccaagtttattgtggaagcagcttctcatggagagtctgacacactggacggcccttcggcaagcgtctgtctggggaaacctgttaaggtggggacgggttcctttggcttgctgcagaatttttccctggagcaacctgttgcgatgtaagcatacatgtagcatcatcagcctgtttgctttactggattagtccaattttgatggaggctgccatagagcagtaggaatgtgttacatatacggtactttttgctagcaagtgcagcaagttatgtcagttctcagttgtgtttgtgtagcaggaaacgaacatgtgaacactgatactccctttggtagtagtatggacattagtctctgtgtagactgtgtggagtatcaggctggcagcagcagtagcagcatgatcttggtttctttgccattttagatgcatttcagcacccttgttttttctgcctttaaacccaaatccgatagccactttgccgttgctgtctgcatgaggttaagatggcagctgagggggaatatatctaggactccagctgcaatatcttttctataattgagtgtg

SEQ ID NO: 867 - DNA, 2136 bp, Oryza sativa
atgatactgctgatggcatgtacagtgatcatgatcttgaaggtgaacctggggcccctgttggctcttgggctgcttgttccatttcagaagctgcctatggagctttggatcacccagttaacagtttagaggattcccctcttatgaacttgcaggaagttttgaagtgccacaagggcacaaattctctggatcatactggtttgcttttcctgtcaaagcatctaaggaaatatagatatggttttgagtatgcatcactagaagttaaggatcatctagaacgagtggacttttctgatatggttgacacggtcattattttatatggcggctcagatatgcagaaaacaaaaggaaatccttggatcactcattttcatttaaaccaggaaacaatgaagataaaaaggttaggactggaatttattgtaagagagattattgaccaatacaacaccttaagaaaacagttgaacaatgcgatcccttcagtttctatttcgaacagcaaatgttctgtaggcaatgagtgtgtcaagaatcagacctgttgcgtcactatggtagtacaggtggaaattaactccatgtcgcaattggacgttatcaaggaacgggtgattccaagcatcctggccacactgttgaaaggatttttggaatttaagaatgttaaggtgcaatgtcaagaggataatgaacttgttctgaaagtcggtatgtctgagcattgcaagagtgggaagttctgggctaccctacaaaatgcttgcatcccaataatggagttgattgattgggagcggagccgaccagagagagtatatgataatttctgctcatatggcatagactcagcatggaaattctttgtcgaatctttaagatccacaacagatgctattggaaggaatatccatcgacagcacttactggttgtggcagactgcctatctgtgagtgggcagttccatgggctaagcagtcaaggtttaaagcagcaaaggacttggttatcaatctcctctccattttctgaagcatgcttttctaggcctgcacacagttttataaatgctgcaaagcgagattcagtggacaatctttctggtactctagatgcaattgcctggggcaaagaaccttgtgcagggtcgtcaggtcctttcaagattctatattctgggaagtcacatgagacaaaacaaaatgagcacatatatgactttctacataaccctgaagttcaggctcttgaaaagaatgtaatggatacctacagaaaaaggactgaaaaaacttccaagcggagatcagcactcaattctgaaggcaatgctaccatcaatggtggtgccatatcttttaatcagaagtttcttaatgctaaagttggtatatgggagaacatcattgacatgcgcacttccttgcaaaacatgcttcgggagtacacattaaatgaagttgtcacagaacaagataaatcatgcttaatggaggccttgaaatttcatcccagagggtatgacaagattggtgtgggaataagagaaatcaagatcggagtgaatcctggtcacccgagctcaaggtgcttcattgtactaaggaatgatgatactactgcagacttctcttacaacaagtgtgtccttggtgctgcaaattctatctcacctgaacttggaagttatatagagaacagacgatctaatagagcagttcggccacatcagttgtagggtgagcccgtcaatgctttacgaacaagtatcagaagcaattttcatggataacgatagattggcgaatgttgcttcttggctgcttcggttaacggggatggcagggtcttacactctacagggatgtgtgtcaactcaactcaactcactcgagctacagatggccgacctgagccttagtgtaggtttcatgccttcacttctgtagcacatacatctatagtaacccttaagtttgtttggacaagaggtagtggcacaaagtgcaataggtgtcgtcgttatccttgcatcaattgtatgcggaaatgatccatattctaaatgagaatcacaaaattttggtcgttgaatttaatctagaatgtgatttattcgtgaa

SEQ ID NO: 868 - DNA, 5695 bp, Oryza sativa
atctagggtcccgcgccgccgccaactctcccccgttcctcccctttccgcgcgagcggcgagccggcgggcggcggctgtcggaggttcgcctcgcctcgcctcctctcccgcgccgccggcgagaaggcccgtaggtgcgttgtgtacggtttcctctccttctccacctcgccctagcctcctctctctctccctctccctcgccctaagcccctacaaaaccccagctccattccccattgctaccgtcacctctccctctccccttcctactctgcctcctccgccaggttttcacgatccgaagcggctccggctcgcgaacggcggcgtcgagcggagcccagtcgggaggggagatggcgcggccggaggagaagctgcggtgcacgaaggagcccttcatcgaggatgtcggcacgcggaggataaagagcatccggttcagcatgttctcggggaacgaggtgcgccaatccgcggaggtgcaggtttggaacagccggatctacaaccatgagatgaagccggtgcccaatggattgctcgacacgcggatgggtgcggcaaacaagcttggggagtgcagtacttgccatggttcatttgctgaatgcccgggtcattttggttacttgaagctcgcccttccagtttttaatgttggattctttaactgtattttggatgtattgaagtgcatctgcaagagctgcagcagggttcttcttatggagaaagatcggctagagtttttgaagaaaatgagaaatcccaaagcagatccgctacagaaaagtgctatcatgaaaaaagtgagggacaaatgcaaactatcccgttgcccctggtgtggattcataaatggtgttgctaaaaagggcagagcagggttgattattcttcatgattgtagcaaaacattggatggaagcacagaagagcttcgggacgcactatcacataagaaagagaaactatctattagtgctgttcgcatgctagaccctgcaattgttctatctcttttcaaaagaatgaccgatgaggattgtgagttgctaaacctcggtgataggcctgagaaacttattgtgacagagattgcagtgccacctgtacctatacgtccttctgttttcgtggctggtggaagaatgagcaatgaagatagcattaccgtcatattgaagagtattgctaatactaattccatccttaaggagaaccttcaaactggtggtcagttcatgaagtgctttgattgctggcaacaccttcaacttcaagttgttgaatatatcaacagtgacgcaccctctcttcccgagtcacaacatcgaggccttgttcagcgactcaaagggaagacaggccgatttcgtggtaacttgtctggaaaacgtaccgagtacactggaaggactgtcatttctcctgatccaaacttgagaataacagaggtggctattcccatcctgatggctcgagttttgacttatcctgaaagagtttcatactataacatagagaagctgcgtcagtgtatacggaatggtccacacaaacatccaggggcaaatttcatcatacaacctgatggaacaaagctgcacttaaagtattgcgatagaagaattgctgctcgagatttgaagtatggctgtgtagtcgaaaggcatttagaagatggagacattgtcctcttcaatagacaaccgagcttgcatagaatgtcaattatgtctcacagggctaggattatgccctggagaacactaaggtttaacgagtctgtctgtaacccatataatgctgattttgatggcgatgagatgaatttgcatgttcctcagactgaggaagcccgcactgaagcgcttatgctcatgggggttcagaacaatttatgtaccccaaagaatggggaaatactggttgcatccacgcaagactttttgacttcctcttttctggttacaagaaaagataacttttatgacaggtcgtcattttctctcttatgttcatatcttggtgatgcaatggaaaacattgatttgccaacacctgctctgattaagcctattgagctttggactggtaaacaactcttcagtgtgttagtacgtcctaacgcatgtacaaaggtgtttctgaatcttactgttaaagagaaaatttataagactcctaagggttcaactctggaacctgaagcaatgtgtcccaatgatggttttgtctacttccgaaacagtgaacttctatctgggcaagttgggaaggccactttaggtaatgggaataaggatggcatgttctccactcttgtaagagattataattctcatgctgcggcaagctgtatgaaccgcttggcaaaatttagtgcaagatttatagggaaccatggtttctcaattggtgtggacgatgtccaaccgggagaacatttaaaccaagagaagaaaatgaaaatagatggagggtacaaagattgccatgatcttattgcttcctattccaaaggtgcactccgtttgcagcccggttgcaacgcagcccaaacattggagcaaagtataactcgtgtactgaatgaaatcagagaagaagctggaaaagtctgtatgaatacacttcactggaggaacagcccattgatcatgtctcagtgtggatctaaaggttctccaatcaacattagtcagatggttgcatgtgttggccaacaatcagttggagggcgtcgtgccccgaatggcttcatagatcgaactcttccccactttcctataaattcaaagactcctgcagccaaaggctttgtcgctaattctttctatactggcttgactgccaccgaattcttcttccatacgatgggtgggcgagaaggtcttgttgatacagcggttaaaacagctgaaacaggatatatgtcccgcagattaatgaagggattggaagatctctcagttttctatgatcagacggtccgcaatgctagtggtggtattgtacagttcctctatggagatgatggcatggatcctgcaaagatggaagggaaagatggaaagcccttaaatttggatcaattgtttatgaaagtcatggccacttgtcctcaaaggggacagaatacattatctccaggtgaaatcttacaaattttaaatgacaagctctctgaacatgatgcctcctctgatgatggttgtagcgaaaagttcaagcaactgttaacgtattttcttgaggatcgtataaaattgctgaagagcacaaggagagcgcttctcctagatgaagatcatgttggagagaggcactccagctttgaagaatccattgctgctaatatttctggtatatctgtgaagcaactacaggttttcttggacacatgtttatctcgttaccacttgaagaaaattgaagccggagcatcaattggggcaattggggctcaaagtattggagagcctggaactcagatgacattgaaaactttccattttgcaggagtagctagcatgaatgttactcttggtgttcctcgcatcaaggaaattatcaatgctgctaaaaagataagcacacctattatcactgctgagttactttctgagaaggatgtgttgtctgcacgcattgtgaaaggctctatggaaaaggcagtgctgggtgaggtggctgaagccataaagattgtgttgaaatcaagtcaaccaaacttggttgttaaactcgatatgcaacgtatagaagccctgcacatgggcatctctgctgactctgtgcagctgtcaatattgaatcatccaaaaataaagctaaaatctgagcatgttcgtgttattgataaatccaagttgagaatttatccagctggaatagataagtccaaacttctatatgagttacatcatctcaaatccatgcttccaaaagtgatcgtgaagggtattccaactgttgaaagagctgtgatcagcgaaactggtgaagaaaatgacaaaagatacaagttgttggttgagggaacaaatctcttggcagtaatgggtactccaggagttgatgctatgaaaacaaaaagtaaccacatcatggaagtgaaccgaacactcggaattgaagctgcgaggagatctattattgatgaaattcagtatacaatgaaaagtcatgggatgaacattgattcgagacatatgatgcttctggcagatttgatgacatacaagggtgaaattcttggcattactagatatggtattgcaaaaatgaaaagtagtgtgctgatgctggcttcgtttgagaaaacagcggagcatctctttaatgcatcatacagtggtcgtgaggatcagatagagggagttagtgaatgcattatcatgggtatacccatgcaacttggcactggtattctcaaagtcagacaaaggcttgaccatttgcctgaatttaaatatcagcctgatccaatattggcgtgatacaagctagaagcctagaaccagcttaatttgtctgaagctggaattctgtacagatatatagaggggttggatgtataagcatgtataagcatcatatagcagggcagctacggcaactgtaatttgaggcaagtatgcactgctgaggtagcattggggcaaaactcccttttttctgatagtccaccgtatgtttcagcttattttggtttcaatcccccaggtttattctgtttccagagcaggattagtttaaagttcaaacatatactagctaggtgcagtgtgccacagtttgattagaattgggcccgctcattgaacttttctaaagaaggaaaaaatggtccctggtctaatgtcaaaagcttgagcagaacaaagtaaatatcacgtctctcttttggttcttccgtttctcctgtgtcttcagagcgagcgtagctgtcactccatagacaaccgcttatttttatttttttttctgatttcctcctagctctcacctgtcaacaacacatttgatctgctaatgctgctgctgccgtcatgcaccaacaagagaagatcgcctggaaagtaaggaaagagatcaaggagctcatctagaaggtatgttgatcgcttttgttaacttgttactctcactccacgggtcggtcggcgtgtcgtgtgagatcggtgctgcatcctcacctactctcccctccattcctccccgatctgtcaagatctcgcacgacttcgtcgtcgtttcttcctttgtctgaccgacggaatagcatatgcagaatgcaactgcatatgctctgcaaattgctgcgaatgtactacgctcctgaccgattcacatcagggaggaggaaacgagggttggtacgatggatgagagtccggaatatacattttctgattcttctttcgtcagacgccgacatacatgacccgtcagtaaaggaccctggttccttttgtttgacgtaatgacatgtcgccgaaattaagaggagaggatgaggaagaagccatcttgaaaagtgagaaccgatacgaaatgtgcgttttccggagggtaatttggaaccataccattataattttgtaaagtttaagatatgccatcggtatcttaatgacatgtagaacccacataagtcagttggatgcgtctttttccg

SEQ ID NO: 869 - DNA, 4713 bp, Oryza sativa
atggaaggtcatcctgatccaacatctgctgctactgccatgatccccgaggcctcgatcagacgcatcaacctgagtatcaccagcaacgaggaaattctgaaggcgcagccggtgaacgagctcgagaagccgatccccatcacgcatcaaagccagctgctgaacaatccatacttgggcctgcctctgcaagtcggcagctgtcagtcgtgtggcagcaacgccatcgaagaatgcgagggtcacttcagattcattgagctgcccatgcccatcttccacccgagccatgtcaccgagctgagccagatactcaacttaatatgcctgagatgcctcaagatcaagaacagaaagaagagcactcttaagggaagcaaattcacttcatgttcacactgtcaggagctcccaccgctgtgcgttgcagaagtcaagaagtccaatggtgcccgtggcttggagttgagagcacctatcaagaaagaactggaagagggattctggagcttccttgatcagtttggcagttgcacgaggggtacctctcattgtcgtcctttgctcccagaagaggtccaaaacatcataaagaagatccctgaagaaacaagaaggtggctttctgttaggggatatattcctcaggatggttttatactgagctatctctgcgtcccaccaaactgcctgagggtttccaatgttttggatggaaatacattcagctgttcaggcacatcgacaaacttattaaggaaagcactacgtaagatacagcagattcgtggttcaaggattggttcctcaaacatccaagtggatcaagttgcagatgatcttcaggtcgatgttgccaactacatcaacctcggaggaacaacaaagggtcacggagatgacacgttcacaagtcaaccaacagcaatgcaatggaagcaaaaaatgaagacattgttcatcagtaagagctcaagcttctcgtcccgtggtgtgattactggtgatccatacattggtctcaatgttgttggggtgcctgaggaagtagcaaagagaatgtcagtagaagaaaaagtcacagaccacaacattgctcaattgcaagacatgatgaataaaggactatgtttgacatatacagatgccaattccatcacgtactcattggatgcagggaaggacaatccgaacaagaaacacaccatactgaaggtcggcgaaattgtcaacagaagggttttcgacggggatattgtcttcctcaacaggccaccaagcactgataagcactcagttgaggccttctatgtccaagtccacaatgatcacaccataaagatcaacccactcatttgtgacccacttggagcagattttgatggtgactgtgtccaaatcttctacccaaggtcgctttcagcaagagctgaagctaaagagctatacactgtggataagcagctggtgagctcccataatgggaaactgaactttcagttcaagaatgatttctcactagctctgaagatcatgtgtggtagggagtattctgagagggaagcaaaccaaattacaaatgcaatgttctcatcagggatgtacccccagaagccactgattggtggaccttactggacctttcctcagattctagagaccactaaatctaatgcaataacactggcagaccatcttgacagagaatctgttggagccttagctactggtaccaccatctcatcgatcctttctacaaagggtccaagggaggccacagaatttctgaatcttctgcagcccttactaatggagtcactgcttattgattgcttcagcataaatttgggagatttcactgtcccaagtccaattctggaagctattcaaaataatccacttgagctaaataagtacagggaaccaattatggatttcataacccattcttctgccataggactgttggttgatcccaaaagtgattccaacatgaacaaagtagtggagcagcttggtttcctggggcctcaactacaacacaacggaagactatacagtagcaggttagtggaggattgcctgtctaagtctctgcacagatgttgcgggagtaccaattgttgcaaccctctagaggaatatggtactgtaaggagctcaatttaccatggactaaacccatatgaggctctacttcattctatatgtgaaagggagaagataatgcgtgcatctaaagggctagtggagcctggcagtcttttcaagaacatgatgtcaagactccgagatgtcacagcatgctatgatggatccataagaacttcgtctggtaacttagttcttcagtttggctcaagggatgcatcaaattgtgtgacaccaggtgaccccgttggtatcttggcagccactgcagttgcaaatgctgcttacaaggcagtgttggctcctaatcagaataatataatttcttgggactcgatgaaggaagtactgcttactagggcaagcactaaagctgatgccaatcaccgaaaggtcattttgtatctgaaccagtgctcttgtgaaaatgaatgcatggagagagcactcacaattcgagcctgcttaaggaggatcaaattagaggattgtaccacagagatatccatcaagtatcaacagcaagcaactcaagcagctcatcatcttgttggccatattcaccttgacaagaagcaattgaatcagattgaaacaattatggacagtgttcttcacaaatgccaggagacttttaggaataacataaagaagaagggatcgatgcgtgaaatattgaagacagtcactttcatttcaagcacaagtttgtgcgaccaacatacagatgatgataaaaaatttcaggtttcctgcttgcagtttttcctccctggaagcatcactaaaaatatatctgaatctactgaacgagttatcgatttcatgactaatgccattttccctataattttagacactgttataaaaggtgatcctcgagttgaggaagccaacctagtaaggattgaaccagaatcaacattttgggtccagagctctggtgcagaacagaaaggcgaggcggcactggaaatcactgtggaagaggctgcggctgctgagagtggcaatgcctggggagtagcaatgaatgcatgtatccctgtgatggatctgattgacaccaccaggtctatgccgtacgatatacagcaagtccgacaggtgtttggcatttcctccgcattcgaaaaagtcacacaggttcagttattcccctttctccttttagctgaaattcagtacctttccaagtctgttggaatgattacaaaatcagttctccaagagcacctgacaacagttgcaagtagcatgacctgcacaggcgatttgcatggcttcaacaactctggctacaaggccacatgtcaatctctgaaggttcaggcaccatttatggaggctacactatcaagatcaatacaatgctttgagaaggcagcagcgaaggcctactccgatcagctgggcaatgttgtatcagcctgctcttggggcaataatgcagaaattggaactggttcagcttttgaaatcctttggaatgacgagaacatgtcatcaagcaagagtatccttggtgggtatggtctgtatgacttcttggaagcagtagaaacaacaggagcaactaaagataaggcaattgttcctcataactactgcttatatgatgttgactgcattccagaggataaagtatgtttagaagaaaacaatcagatcacctggacagacaaaccaaaagctgaattcctgatggaatctgagggtaggagggcagggatgcacagcactggccaaaaacatccgaggaagccaaattggcatgaaggaaacaccaagagttccccaaattctactgcagtagaatttactggtcaggtgttccagagaaggcaactgaagaccaagagtaactggaactcagatgcaacacagcaagatgataaaccaagttggtatagttcaaatagcgcgggcacacagaacttcaccattgcaggatcatcccgaccaggtgaatggaacaggaagaataataatcgcggtcaaggtggtggtagagaagtgtggaaatcagagggaccacaccgtggaggcagtagcagtaataggaatcaaggtggtggtagagcagtgtggaaatcagaggcatcacaccgaggcagtggcaataataggaatcgaggtggtggtagagcagtgtggaaatcagaggcatcacgccgtggaggcagtatgaggcaggtagcgagttgtgcttttacaccagtggagcagcagatatttgaacaaatcgaaccaatcacaaagaatgtaaagaggatcatccgtgaatcgagggacggtattaaacttcctccagatgatgagaagtttattgtcacaaatgttctcatgtaccacccagagaggaagaagaagatagctggcaacggcaactacataacagtcgataggcatcaggtattccatggaagtaggtgcttatatgtcatgtcctcagatggatccagaaaagatttctcctacaagaagtgcctggagaactacatcagagctcagtacccagatgctgcagattcattctgcagaaagtacttcaaatga

SEQ ID NO: 870 - DNA, 6900 bp, Oryza sativa
gctctcgcactcgcactcgcgctcgtgtgggttcccttctcggcttctccgaggcgagggcttggctgcaggctaaaaccctctccgcccccaccccccgcgcggtggctagggttttagggcgagggtgggaggaggcaggcaggcgcgcgcgcgcgcgcgggtgttcagatagatggaggaggaccagtcagcaattccggttgctgaaggtgccatcaagagcatcaagcttagcctatccactgaggatgagattcgtacttattctataaatgactgtcctgtcactcatcctagtcagctcggaaatcccttccttgggttacctttggagacaggaaaatgcgagtcctgtggtgcctcagaaaatggaaaatgcgaagggcatttcgggtacattgagctgcctgtgcctatatatcacccttgccatgtaacggaactgaggcagatattaaatgtggtatgtttgaaatgcctccgcgtcaagaaaggaaaggtcaaacagacagagggaaaggataacacatcagcattgtcatgctactattgtcgggatcttccggcattatctttgaaagaaatcaaaacagcagatggtgcatttcgtttagagttgaaaatgcctcctaggaaattcatgacagaaggctcatggaacttccttgacaagtatggatttcaccatggtggaacctcccactgcaggaccttgctcccggaagaggctctcaatatattgaagaaaattcctgaagaaacgaagaggaaactagctgctcgtggttacattgctcaatctggatatgtgatgaaatacctccccgtgccaccaaattgtttatacattccagaatttacagatgggcagagcatcatgtcctatgacatatcaatatctctgctgaagaaggtgcttcagaaaatagagcagataaaaaagtcaagagctggatccccaaactttgaatcacatgaagttgaatcatgtgatctacagctctctattgcccagtacatacatctaaggggcactacaaggggtcctcaagacaacaccaagagatttgcaatcagtactgatccttctgcgttatcaacaaaacaatggctggagaagatgagaacattatttatcagcaaagggtcagggttttcatcacgcagtgtacttactggagatccatatattggagtagatgtgattggactgccttctgaagtggcaaaaagaatcactttcgaagagcaggtaacagacatcaaccttaacaggttgcaagagattgtggataagggattgtgtttgacctacagagatggccaggcaacctatgccatcaccgttggatccaaaggtcacactaccctgaaagtcggacagactatcagtaggagaattgttgatggggatgttgttttccttaaccgtccacccagtacccacaagcattccctccaggcatttcgcgtgtatgtccatgaagaccatacggtcaagatcaatccgctcatatgcgcaccttttgcagcggactttgacggtgattgtgtgcacatctattatccacagtcccttgctgcaaaagctgaagcactggagcttttcagtgtggagaagcagcttaccagttcgcacagtggcaaggtcaatctccagctagttagtgacagtttgcttgctctgaagcatatgtcttccagaacaatgttgagcaaagaagcagctaaccagctggcaatgcttgttacatgttctcttccagatcctgctgtgatcaagtcaaagccgtactggacaatctcgcaaatagtgcaaggtgctctgccaaaagccttaacttctcaaggggacaaacacgtagtcagggacagcactattataaaactggatcttgacaaagaatctgttcagacatcattctcagatttagtgtattccactctttctgttaagggtccaggagaagcactacaatttttgaatgtgctgcagccattattgatggaattgattcttttggatggctttagtgtaagcctccaggacttcaatgttcccaaggttctattggaagaagcacagaagaacattgaaaaacagtctcttatccttgaacaatcaagatttgcagaaaatcaggttgttgaaatgcgtgttgataataatttgaaggacatcaaacagcaaatttcagattttgttgtgaaacgctctcatcttggacttctgattgatccaaagagtgactcttcagtgtctaaagttgtccagcagcttggttttgtgggtttacaactttaccgtgaggggaagttctactcacgtcgtctggtggaggattgctactacacttttgtgaacaagcacccagctgtcagagaagaacattctccagaggcatatggtcttgtacggagttcatattttcatggccttaatccgtatgaggagctggtgcatgctatttcgacaagagaagctattgttcgctcctctagggggttgacggagcctggaacactatttaagaatctaatggcgttactgcgggatgtcgtcatatgctatgatgggacagtaagaaatgtctgcagcaagtctatcatacaacttaactacacggaggatgatgccttggacttccctagtgcaataggtcctggcgaaccagttggtgtcttggctgcgactgctatctccaaccctgcatacaaggctgtcttggatgcatctcagagtaacaatacttcatgggagcggatgaaggaaatacttcagacaacaagtcgctacaaaaacgatatgaaagaccgaaaagttatcctatttctgaatgattgctcttgtgccaagaagttttgcaaggaaaaggctgctattgcagttcagggctgcctaaggagaattacgttagaagattgtgctactgacatctgcattgaggatggaaactgggctgcacccgctgggtttcagcaccccgtaccacccccgcaatgcaagatattgcccgtccccatccccatccccgcacacgggtcagtcaagtttccccctgtccccatccctgcaccagaacaccttaaatataacattcacgttgtcaggtaccagaagcaaataggtttagatggaacttcagaagcagccccagcacttgttggccatattcatcttgacagggcacatttagaaaggatcaacattagcactgaagatattcttcagaaatgccaagaagtttctgggaaatatgggaagaagaaaggacatctcagtaacctgtttaaaaatattacattctctacttgcgattgtttattcacacagaagctggttgatggaaagctacctaagcttccgtgtttgcaattctttgtttctgataacatgatagtatctgaatcagtggagagagcagtcagtgtgttagctgattctctatgtggagtgcttttgaatacaatcataaaaggtgatcctcgaattcaagaggctaaaattgtttgggttggatcggatgcaacatcttgggttaaaaacacacagaaggcatcaaagggtgagccagcagtagaaattattgttgaagaagaggaagctttacatattggtgatgcctggagaacaacaatggatgcctgcataccggttctgaacctcattgatatacggagatcaatcccttatggtattcaacaagtgcgagaacttcttggcatctcatgtgcttttgatcaagttgtgcagcggctttcaacaactgtaaggatggtcgctaaagatgttctcaaagatcatctggtacttgtggcaaatagcatgacatttactggaaacctgaatggatttaacaatgctggttacaaggccaccttccgttccttaaaagttcaagtacctttcacagagtccacattgattacccctatgaaatgctttgagaaggctgcagagaaatgtcattcggattcattgggatgtgttgtttcatcatgttcttggggcaagcatgctgcaagtggtactggatcatcttttcagattctgtggaatgaaagtcagctgaaaagcaataaggagtatggtgatggcctgtatgattacttggcattggtgcgtactgacgaggaaaaggcaagatacacattctttgatgatgtggactaccttgcagaagagaacgaggcagatgtgtgcttatctcctgaattggatgggaccattggtcaaccgatcttcgatgataatttggaagagcaagatgttcagaataacagctcgtgggataatggcacaacaacaaatgcaagctgggaacagaatggtagtgctggaaatgattctgataaatggggaggttggaatgatgcagctgcaggagctgacacgggagtcacaaaaccagcaaaccaagggaattcgtgttgggatgtgcctgcgacagtggaaaagagttcctctgattggggaggctggggcactgaaaaggcgaaggagaaggagaaaatatctgaagagccagctcaacatgatgcttggtctgtccagggccctaaaagggcaacagatggaggagccagctggaagaagcagtctagcactcagaatgatgggaactcctggaaagagaacaagggaagaggatcaaatggaggttcctgggagaaagataatgcgcaaaagggatcatggggcaggggcaatgatgaagctgaaaataataatgatgtgcaaaacaaatcttgggagactgtggctgcagatgctcatgcttctacagagaagtcctggggcaatgttactgcatctccatcggataatgcatggagtgctgctccggtttcccaagggaatggaagttcagatacaaagcaatctgattcttgggatggctggaagtctgctggagttgacaaagcaattaacaaagacaaggaatccttgggcaatgtgcctgcatctccatcatttagtgcgtggaatgcttctccagtttcccaagggaatgaacgttcagatgcaaagcaatctgattcttgggatggctggaagtctgctggagttgacaaagcaattaacaaagacaaggaatccttgggcaatgtgcctgcatctccatcatttagtgcgtggaatgctgctccagtttcccaagggaatgaacgtttagatgcaaagcaatctgattcttgggatggctggaagtctgctggagttgatgattcagttaaagacaaggaatcctggggtaatgtgcctgcatccccatcagatagtgcgtggaatgctgctccagtttcccaagggaatgaaagttcagatgcaaagcaatctgattcttgggatggttggaagtctgctggagttgatgcttcaactaacaaagacaaggaatcctggggcaatgtgcctgcatctccatcagatagtgcatggaatgctgctccagtttcccaaggggatgatgtctggaattctgctgaagccaatgagtcacgtaataaggactggaaatcagatggatggggtgccagaggtggcaattggaggggccaaagaaacaatcctggtaggcccccaaggaaacctgatggcaggggtctgcctaggagacctgatgagagggggccaccaaggcgacactttgacctaacagctgaggaggaaaagattctaggagaaattgaacccactgtgctgagcatcagaaagattttccgtgaatcaattgatagcataaaactttctccggaagacgaaaaattcatcaaagagaatgttcttgaacaccaccctgagaaacaatcaaaggtgtctggtgaaatcgatcacataatggttgacaagcaccaagtgttccaggatagtcggtgcttgtttgtggtgtcttcagatggaactcggtcagatttctcctatttaaaatgcatggagaattttgtgaggaagacctaccctgagcatggggactcattctgcaagaagtatttcaagaggcgccgtgaccaaccaccagcagctgatggaggcacagcaccaggcactccagctggggctacacagtctactgcagttgatacccaggagggcacttcacagcagacccaaccagatatcgcaaccgctccagctgcaactcaacaagagactcttcaagacactccagctcctccagcagacgatggattgctcgggaagggacctagcccgtctgactgatgctcagggtgcgcttagagctgccaacatcctgcttgtgctctaatcctgccactctttttttcctacttggcctgacattgcctagtgactagacagatggtgactttgtgtagtagagaagggttagcagtctttaggtctcactcttccagacgaactctgtaaattctggatgttagtgagctgcatcccgtagcttaaactcgtttttaccctctcttttttttttatcttttttgtctttccagtatggttatttggttagtccaatgcaagccgattctgcgaggccgtgccgaatctgatgattttgttgttctgcaaggcacagagctctcgctggtgctgtttcattttggatgctgttacagggttttgtaaagacactgaaactaccatgcgaatcagcaaaagatggattccctgctgtgaacaagcaggtggccttgcatgaattcattcatcaaacatgaggtcttgctggtgacgccacaaatttggtttgatgtgtttgcactgagctggaccaatctgttcttgaaatttcttcaggttggtacagaaaataggtaatattgtattctgtcatttcattaccaagaccagtggtgtgaacaagctggaggcattgcttaaatgcatccgtcaaccgtatgattgtttcagca

SEQ ID NO: 871 - DNA, 1384 bp, Oryza sativa
cacttactaaatgggctattgaatatgaagaacctgctggggatgcatttggtgaaaaccatccagaagctgcagtatttgtcgaaaactgcaatgtgattctgaaggcaattatggacaagtgtggtgattctgatgattgcatctccacttctgaggctgctgaacgagcagctaaactttctgaggacaagattaagaatctgcccgtgcctggcgaagtagaattcataaatggtggccctccgtgtcagggtttttctgggatgaacagattcaatcaaagtccctggagcaaagtccagtgcgagatgatcttagcattcctgtcatttgcggagtatttccgtcctagattctttctcttagaaaatgttaggaactttgtctcgttcaacaaaggacagaccttcagattgacactggcatcactcctggagatgggataccaggtccgatttggaattttagaggcaggggcttatggtgttgcgcagtccaggaaaagggcattcatttgggccgctgcacctggagagactcttccagagtggcctgaaccaatgcacgtctttgctagccctgagctgaaaataactctacctgatggcaagttctacgccgctgtcaagagcaccgctgcaggagcccctttccgctcaattacagttcgagatacaattggggatctaccagctgtggaaaatggcgccggcaaaccaacaattcagtacggaagcggtcctgtgtcttggttccagaagaagattagaagcgacatggcttcactgaatgaccacatatctaaagagatgaatgagctgaacctcataagatgcaagcacattccaaagcgcccaggttgcgactggcatgacctgccagatgaaaaggtgaagctgtccacagggcagatggtggacttgatcccttggtgcttgcccaacacagccaaaaggcacaatcagtggaaaggactgtacggtaggttggactgggagggcaatttccccacttctgtaacggatcctcagccaatggggaaggtcggcatgtgcttccatcctgagcaggacaggatcattactgtccgtgaatgtgctcgatcccagggcttccccgatagctaccgtttcgctggcaacatccagaacaagcacaggcagatcgggaatgccgtgccaccgccccttgcctatgccctcgggaggaagctcaagcaagccatcgacgccaagcgttgagtggcttttaacttcactgcatcgccctcattttttggtcggtccaaataggtttaactaagcattacagttttctatattttgtgagcaattggactcctaaaattaattctgggatggttacatggattaccttttgt

SEQ ID NO: 872 - DNA, 2567 bp, Oryza sativa
accgtacacccccaaaacccccctgccttctctcgccgattccgccaccgccgccgcgccgcgcctcgccgccggccgcccttcgatctcctcctcctcctcggaatggatctctacatggacgactacatcgacccctacgaggaggccgaggcggaggccgccgcggaagccgccgggctgacgtccgcggcagcggcggaggactcctccgacgagggcgactccgaggacgactccgaggccgagagcgactacgaggagaggtcctacggcctcctccgctccggcaaccaccgcgtgcgcaacccggacggcaccttccgctgccccttctgccccggcaagaagaagcaggactacaagctcaaggacctcctccagcacgccgacggcattggcgcctccagcaagcgccgccgccacggccgcgagcgcgccttccaccgcgccttcgcccgattcgtccgcaccgacccttccttcgcccaagacctcgccgccatcaacgggatcgccaccactgctgatgctatctctaattctagtgctgccggtgccaaggagaaggcggatgccaatggcgacacagacggatccgcttcggtggcggctgtggccgcggggaatagacgggaggaggagaggtttgcttggccatggagtggggttcttgcagctggtgcagggttcaatgccgaggacttcgcggatagggtcgcaatgtttggtttggatgatgttgtgcctttagttgtcgatgatgcggaaggcgctgatagctttgcgattgtgaggttcgctaatggttggggtggattcggcgatgcgctcacgctcgagaaccatttcaacaagaataagcttgggaagaatgaatgggatgcaaggggtagtgctggagatgctgtgaagggagatgatggggacacagatgttaaggtttatggttgggttgcccgagaaggggactataatgccgggaatgtggtgggcaggtatttgaggaagcatacgaacctgacaaccatagatgaggtctccaagagtgaatcggaaaagtcggggaagatggtagcgatactggcaactcagatcgaggcgaaaaatcgattcttgcaggacttggagacaaaaaagaatgcaaccgaactctccattgcacggctcgaggaggacaacaggaagctacacgatgcatataatgaagaaatgcgcaatctacaccggagagctcgtgattatgctttaagagttttccaggataatgaaaacttgaagcttgaattagatagcaggaggagagaattgaattcacgtgctaagcagcttgaaaagataacagctgagaatgcaagcgacaggaaaaaacttgatgatcagaagcaaaaggcaaaggatgataatagtgaacttgagctagcaagcatagaacagcagagggctgatgaagatgtaatgaagctagttgaggatcagaagagggaaaaggaagatgtccttgcaagaatgcttcagctggaaaaagagctgcatgaaaaacaacagcttgagcttgaagtaacacggctgaatggtacacttcaagtgatgaagcatttggaaggagacgatgatggggatattcatgataagatggagaaattgagtgaaagattagaacatgaaaagaaacgtttggaagaattgagcggagagctggtgaagaaagaacgtgaaagcaacgatgagttacaagaggccagaaaagaactgataatgggtttggaggacatgctaactgggcgaactgctattgggataaaaaggatgggggaacttgatgagaaacctttccaaaatgcatgcaagagaaagtacggaaacgatgactatgagaccaaagctgcggagctggtctcaagttggcaggaggaaataaagaagccatcctggcatccttataagattataacggttgatggcgaagataaggaagttgtagatgatgacgacacgaagctgcggcacttgtggatcgagtacggtgacgatgtgtgcaatgcagtgaagaccgccctgagcgaggtcaatgagtacaatgccagtggacggtatgttgtgcccgagctgtggaacttcaggaaaggccgaaaggcgacaatgaaggaggtgctcaagtacatctttggacagatagagacaaccagcaagcgcaggaggccgtgaagttcgtccttcgatggatgaagaagctgacaggcaagcgaaggatggtttgaggtgctgggtattggtgctaggtatcaagagctgctgccttctgttatcatctcaggtcaggttggaggcgctggtcaattgatgggtctaagttgatgaatactagtgtattgatcaatggatgcccataaggctgtgccaatccttagttataatgattatggttatggtcagtgtcaggctgtagaaataatcctgtgttgtgtccctttgaattgtagaataatcgtctgtaataatttcgatatactttcgtggtccaagacatcataaatctaagtgattagctactaatttttctgtga

SEQ ID NO: 873 - DNA, 2275 bp, Oryza sativa
acactagtcgtcgtcgagaggcgcggaggcaacgccgtgtggtcgccatcgccatcgccttcctcctcctcctcctccgccgccgcgcgcttcctcgccaccgcgcgcccagggccatcggcggcggacgccctcgcccacgcgcgcgagagaggggggcgagagattatcggacgagtcgctttgcggagctttctagaatggtggactgggcttcagatagcgacaatgataagttcgagtgggacacagacggtgaggctgagacctcatctgccccggccctaaggaacatagatgctcctggtccgtccacgaggctgccgcaggatgcaaatgggaaggccaacgggtcaggtgctttggttgctgaatttatgggaatgggattcccaaaagaaatgatcttgaaagcgattaaggagattggtaacgataacaataatctagttctcttatttgcttctggttgcattttgaatcttctgtttcaactgctgtcttttctttcaggggatacagatacagagcaattgcttgagttacttctgacttatcaggtatttgcccacatggttgcatcactctgtttattattatctaatgctctactgtacaagtgatgccgtgtaatgcaggcaataggcggtgacgcttcagtgggtaactgctctgcttcggcctgtgccccccagactcttgaagtcgacgaggaggaggatgatactaattgggatgaatatgatactgctggcaattgtgacaggactcctcactctgatggttctggtgacgaggatttctttcaagaaatgtcagagaaggatgaaaaaatgaagtccttagtcaacatgggttttcctgaagatgaagcaaagatggctatcgatagatgtctcgatgcgcctgtagcagtgttggttgattcaatctatgcatcacaggaagcaggaaatggttactctgcaaacttatctgactatgaggatacagagttcagttcctttggaggaagaaagaaaacaagatttgtggatggaagcaagaagagaaagcggtatggaagtgggccatctgggaatcaagtgccgtttgatggcagccacgaagagcccatgcctcttccaaatccaatggtgggattcagcttgcccaatgagaggttaaggtcagtccacagaaatcttcctgaccaagctcttgggccaccattcttttactatgaaaacgtggccctagctccaaaaggtgtatggacaaccatctcaaggtttttatatgacattcagcctgagtttgtggactccaagtacttttgtgctgctgccaggaagaggggttatattcataacctgccgattgagaacaggtcacctgttctcccaatgcctcccaaaacaatatctgaagcctttcctaataccaagaggtggtggccttcctgggatccaaggaggcagttcaactgcttgcaaacttgtatggcaagcgcaaagcttacagagcgaattcgttgtgctttgggtagattcagtgatgtaccaactccacaagttcagaagtatgtcttggacgaatgtaggaaatggaacctagtttgggtcggaaagaataaggtcgctcctctagagcctgatgagatggagttcctgttagggtaccctagaaaccacactaggggagttagcaggacggagaggtacagggctctcgggaattcattccaagttgatacagtagcataccatctctctgtgctgagggacctgtttcccaatggaatgaatgtcttatccctgttttctggtattggaggagcagaggtagctctccacagactggggatacatatgaaaacagtgatctctgttgagaaatcagaagtgaacagaacgattctgaagagctggtgggatcagacacaaactggaacgctgattgaaatcgccgacgtgcggcatcttactactgaaagaattgaaacattcatcagaaggtttggcggttttgacctggtgattggtggcagcccgtgcaacaaccttgctggcagcaaccgccatcaccgagatggtctggagggcgagcactccgcgctcttctacgattacattagaatattagaacatgtaaaggctaccatgtcagcagtctagtttaagctatcacattaactaactctgtgatttattgttgttaacgaagttagaacctgttgattgatattgctgaacctgatgtgatgttattgcactcaaacaggagtgttttttcc

SEQ ID NO: 874 - DNA, 1314 bp, Oryza sativa
atgaggatagcgagttcgagtgggatactgatggatgctaatgggaaggccaatggatcagcaccatcagctttggtggcttactttttgggaatgggtttctcgagagagatggtcttcagagctatcaaggagattggtaatgataacaataatacatttcctcatttgcttcaactgttgccgtttctttcaggggacacagattcggagcaaattcttgagttacttctcacttatcagattcttgaagaagaagatgaggaggaggatgttaattgggacgaggatgatactgttgacaattttgatagggctacttactctgatggttctggtgatgaggactttttacaagagatgtccgagaaagatgagaaaatcaagtccttagtcagcatgggttttcctgaagatgaagcaatgagggctattactagatgcggtctggatgcgtctgtagatttgttggttgagtcaatctatgcaccagcatctgcaggaaatgtttattttacaaacttatctgactatgaggatacagagttcagttcctttggaggaagaaagaaaacaaaattaatagatggaaccaagaaaaaaagagaacggtatagaagtagaccacaatggaatcaagtgccatttgacggcagccatgaagagccaatgcctcttccaaatccaatggtgggattcagcttgcccaatgacgggttaaggtcagtccacagaaaccttcctgaccatgctcttggaccaccattcttttactatgaaaacgtggccctagcaccaaaaggtgtatggacgaccatctcaaggttcttgtatgacatttatcctgagttcgtagattccaaatacttctgtgctgctgctaggaagaggggttacatccataacttgccgattgagaacaggtcacctgttcttcccattcccccaaagacaatatctgaagcctttccttctactaagatgtggtggccctcttgggatccaagaaggcagttcaactgcttgcaaacttatgtggcaagcgcaaagcatacagaacggatacgatgtgctcttggtagattcggtgatgcactacctccagcagttcagaagagtgtcttggaagaatgtaggaagtggaaccttgtctgggttggaaagaacaaggttgctactctagagcctgatgagatggaattcctattgggataccctaggaatcataccaggggagttagcaggaagcgagatatagagctcttgggaattcattccaagttgatacagttgcataccacctctctgtgctga

SEQ ID NO: 875 - DNA, 1422 bp, Oryza sativa
atgaggatagcgagttcgagtgggatactgatggatgctaatgggaaggccaatggatcagcaccatcagctttggttgcttactttttgggaatgggtttctcgagagagatggtcttcagagctatcaaggagattggggacacagattcggagcaaattcttgagttacttctcacttatcaggcgataggcagtgacccttcagtgggtaacagctctcattctgcctgtgacccccagattcttgaagaagaagatgaggaggaggatgttaattgggacgaggatgatactgttgacaattttgatagggctacttactctgatggttctggtgatgaggactttttacaagagatgtccgagaaagatgagaaaatcaagtccttagtcagcatgggttttcctgaagatgaagatacagagtttagttcctttggaggaagaaagaaaacaaaattaatagatggaagcaagaaaaaaagagaacggtatagaagtagaccacaatggaatcaagtgccatttgacggcagccatgaagagccaatgcctcttccaaattcaatggtgggattcagcttgcccaatgacgggttaaggtcagtccacagaaaccttcctgaccaggctcttggaccaccattcttttactatgaaaacgtggccctagctccaaaaggtgtatggacgaccatctcaagattcttgtatgacatttatcctgagttcgtatattccaaatacttctgtgctgctgctaggaagaggggttacatccataacttgccgattaagaacaggaattataccaggggagttagcaggacagcgagatatagagctcttgggaattcattccaagttgatacagttgcctaccacctctctgtgctgagggacatattccctaatggcatgaacgtcttgtccttgttttctggtattggtggagcagaagtagctctccacaggcttggaatctgtatgaagacagtggtcttagtcgaaatatcagaggtaaacatgacgttgctgaggagttggtgggaccagacccaaactggcacgctgattgaaatcgcagatgttcaaaatcttactgctgaaagaattgaactattcatcagaagatttggtggctttgacctggtgatcgggggcagcccgtgcaacaacctcgctggtagcaacagataccaccgtgatggcttggagggcaagcactcagcactattctatcactactacagaatcttggattctgtaaagactattatggctagcatttttggtgcgaaaggaaagttgtttcgccatgttcgcaaggcccttctgttgaaacaatcctcctccttgacactgaaaactgaacaagatccttccaataacagtgataaggattccatggacaaataa

SEQ ID NO: 876 - DNA, 4377 bp, Oryza sativa
atggccgacgacgaggctgccgtcctcccgcccccgcctccgctgccgccgccttgccgcccccacaggcagctccgcccgagggggtctcgaccgactgctgataccacccctcgcactagccagttggtggaggtgttcgaggcggcgctgcgggggaacaccatcgcggtgctcgacacggggtccgggaagaccatggtcgccgtcatgctcgcgcgcgagcacgcacgccgggtgcgcgccggggaggcgccgcggcggatcgtggtgttcctcgcgcccaccgtgcacctcgtccatcagcaattcgaggtgattcgtgagtacactgacctcgacgtgatgatgtgctctggagcatcgcgggttggcgaatggggcgccgatcattggaaggaggaagttgggagaaatgagatcgttgttatgacgccacagatactgttggatgctctgcggcatgcttttctgacaatgagtgcagtgagcttgctaatatttgatgaatgtcatcgtgcttgtggaagccatccatatgcacgaataatgaagatatacatcgtagaagatcgaaatgagcttgagagcttttcccctcctacaacaattgtgaacaaatactatgatgcttacatggttgattttgataatctgaaatcaaagcttcagatattttctgatgagtttgattctttgttggttggtcttcaagaatcgccatctaataaatttaaagacaccgataatatcctagagacttcaagaaagagcttgtccagataccatgggaaaatattgtacagcctaaacgatcttggtccaattatcacctctgaggtagtcaaaatacatattgaaagcgttaagccattatgtgattctgaagactgcattttttctaaagctagcttgtgcttacatatgtcttattttaaagaagctttaagtctaatagaggaaattcttccacaaggatatggtgaactaatgaaatcagaatctggttctgaggaattaactaaaaggggatacatttcttcaaaagtgaatacgctaatcaacatcttcaaatcgtttgggtcatcaaatgaagtgctttgcctaattttcgtagacagaattataacagctaaagccgtcgaaaggtttatgagaggaattgttaacttctcttgtttttcaatttcttacttgactggagggagtacatcaaaagatgctctgagtccagcagttcagagatttactttggatttgttccgagctggaaaggtgaacttgctttttacaacagatgtgactgaagagggcgtcgatgtacctaactgttcttgtgtgatacgcttcgacctacccagaactgtttgtagctatgtccaatctcgtggtcgtgctagaaggaacaactcggaatttattcttatgattgagaggggaaacttgcagcagcaagaacacatatttcgtatgatacagactggttactatgttaaaaactgtgcactctatagacaccccaatgctttatcctatgacttgtctatccaagggatgtacacctaccaagttcagtcaactggagcaactataaccgcagattgctgtgtcaacctaattcgtaaatactgtgagaagcttcctaaagataggtatttcatgccaaagccttcctttgaggtgaccattgaagatggattattcaaatgcacattgacgctacctcgaaatgcagcatttcaaagtatagttggccctttaagcagttcaagtaatttatccaagcagcttgtatccctagaggcctgcaagaaattgcatcaactgggagaacttaatgatcatcttgtacctttgactgaagaacctatggatacagatttcactacagcagatgaaaaatgcatatctggaccaggaacaactaaaaggaaggagcttcatggtactacatgtgttcttgctttatcaggaacttggattcatgacagtgaaaatattacactgaatacttacagaattgattttctttgtgaccaagagggtgaaaactatgctgggtttgttctcttaatggaaccagaacttgatgatgatgtggcaccctcaaaaatggatctgttcctgatccctaataaaatggtctacaccactgtaactcctcgcggaaaagttcaactaaacaaaaagcagttaggtaaagggaaattgttccaagaattctttttcaatggaatctttggtagattatttcatggttctcgaaaaagtggagcacaaagggattttattttcaaaaagggtcatgaaatacagtggaacacggaaagcatgtacttgcttttacctttgagggattcttcatatatccaggatgacctaagcatacactgggaagcaattgaatcttgtgctggtgcagttgagcagttgtggagttcgtatcaaggagatgaaaatgtcattcctgtaaattgtattccacaaaaaagaagagggggccaagaagaaattattcatctggccaataagtctcttcattgttccagcatcaaagattcagtcgtgctatcactgcatacaggaaggatatacactgttcttgatttgatcttagacacaactgcagaggactcgtttgatgagatgtatggctccactggcaaacctctgctcatggaaaaagaacaaattcatgctcgggttccacctgaactacttatccatctcgatattttggaagctataacaactttaagatgctgtgagacattttctctggagcgtttagagctgttaggagactccgtgctaaagtatgtggtaggatgtgaccttttcctaaggtatcctatgaaacatgaaggtcagctctctgatatgagatccaaggctgtctgcaatgctacacttcataaacatggaatatggcggtcgttgcagggttatgtacgtgataatgcttttgacccacggcgttgggttgctcctggacagatatcgttgcgcccttttccttgtaactgtggaatcgagactgcatttgttccttctcatagaaggtatatccgagatgacccatctttttttgtgggaaaaccatgtgacagaggtcataggtggatgtgctcaaaaacaatatctgattgtgttgaagcactggttggagcatattatgttggtggtggcattgctgctgcactttgggttatgaggtggtttggaatcgatatcaaatgtgatatgaagctattgcaggaagtgaagttcaatgcatctcatttatgctccttatcaaaaataaatgacattgaggaactggaagcaaaactgaagtacaacttctcagtcaagggccttcttttggaagccataactcatccatctctgcaggaattaggtgttgattactgttaccagcgtcttgaatttcttggtgattctgtgctggatctacttcttacacgtcatctctatgctactcatactgatgttgatcctggagaattaacggatttacgctccgctttggttagtaatgagaattttgcacaagcagttgtaagaaacaacattcacagtcatctacaacatggatccggaatacttttggagcaaattactgaatatgtcaggtcaaatttggagtgtcaagggaaagagagtgaattccttcaacatactacatgtaaagtacctaaggttcttggtgacattatggaaagcatcgctggtgcagtatttatagacaccgattttaatgttgacatggtttgggagattttcgagccattgctttctccactgattacacctgataagcttgcattgccaccttaccgtgagttgctggagctatgcagtcacattggttgcttcttaaattcaaaatgcaccagtaaaggagaagaagtaattatagagatgtcactgcaactacgagatgagctgctggtagcacaagggcatgacagaaacaaaaagagggcaaaggcaaaagcagcatctcgtattttggcagatcttaagcagcaacagggtctttcaattaaacaatgtttgtccaaggctaaacagctggatatcgtgacttcagatcttcagtttgacttgacaagtttgtgcttccactcaaaatggagaaaggtggacctcgaagtgcgcttttcaagctatgcaagattttgcagtggccaatgccagaattcgaatttgtggaacaaaggttcaggactcctattgttatggatggggcgacaacaacaaacttcaatagctttgtttcgacaatcaccttgcacatacctgacgcaacaaccattacatttcaagtgtttggagagattaaagatacgtcttagagaaagcacttggtag

SEQ ID NO: 877 - DNA, 5862 bp, Oryza sativa
gtcacgcattcccgcgaatccggcctgctcgagacctcctcccgtcgcgacgccgcaagccatcaaagcgcctcctgcttccgctcctatccaaggcgaaccacactctgcgatcgagagctcgctgagccgtaaaaccctagctaatccttctctctccccccctctcgctgtcgtctccgtctccgtctccgatctccgcggcctcggttgcgggctgcggctgcgccggtgcggctccatggtcccggagccggctcccgcggcggcgacggagccgaggcgctccacgcgcaggcgcctaatgacggccgccgcgatggaggccgaggcggaggcggtggccgacctcgacgagatcgaccgcgagatgtcgcgcgccgagtcgcgcaagcgccagcgcaggacggcgaaggagaagcctggtgcccgtaagggagcgaccgaatggaagccggaggacgtggagaaggcggcggcggcggagggggtggccgagctcgacgagatcgaccgcgagatgccgcgccccgagttgcgcaagcgccagcgcaggacggcgaaggagaagcctagtgcccatgagggagcgaccgaatggaagccggaggacgtggagaaggcggcggcgcaggagcccgaggggaccgagctcgacagtgggttgtcgcccgcagagtcacgcggcaagcggcagcgcggggtggagaaggtcaagcgtcgtacccgtaagaagacggccaaggagaagacgaaggagacgaccgagaagtcggcggctcaggcgcccgagaagatgaaggtgaacgatgcgggtggcgcgctggccgaagacgtgtgcgcggatgagccggacgccgaacagatggccatggaggaggaggaggaggcagccgacgtgctggaagcagaggagaggatgggtaagtgtgtcggagaaggatcagccgagaaggctgcgacgaggaagagggtggcgcggccaagcactgcgagaagggtggaggactcagatgaccactttgtgggcgatccagtaccggatgatgaagcgcgacaacgatggcccgtgaggtacagtagaaaggggtctgattcgcttcttaagcaggagcctgacgaagatgaagaaatgaaggctcgatgtcactacctggctgctaatgtggatgatgaaatctatcatcttgatgatgatgtctatgtcaaggctggtcctgatgaggaaaattacattggacggattactgaattttttgaaggagtcgaccgtggatcatatttctcttgtcagtggtttttccgtacagcagatacggtcatctcatcaaagttgttaaaggtgcatgatcatagacataaccataagcgtgtttttctttcaaaggagaagaatgacaacttgattgagtgcatagtctcaaaagtaaagattgcccatgttgatccaaatatgacgcctcaagcaagagctcatgctatatctgattgtgacctgtactatgacatgtcttactctgttgcatattccacgtttgcaaatcttccagcagataatgatggtgcattggggagtgaggcaacatcaaatatttcctgcgatgatgctgacaattcttctaagggaaaattgtcggctgatattgtggcaccatatagtgaacaaacagagacagcttctctgcttgatctttactcaggatgtggcgctatgtcaactgggctttgtttgggttttgcattttctggcataaatttagagactaggtgggctgttgacataaacaaatatgcttgtgcttgtctcaaacataatcacccatactcgcaggtgcggaacgagaaaactgaggattttcttgcccttattcagcagtgggatgcactttgtagaaaatatgttgtccacaaaaacgatacactagaacctagtatagatatgcccttaaatgatgctgacgatgtaaatgagcctcttccagaagatatattcgatgtagaggagctccttgagatatgctatggtgatccaagtaacacaggaaaaaatggcttgtggtttaaggtgcggtggaaagggtatgatccaagttatgatacatgggagccaattgatgggctcagtgattgccctgagcgtattaaagaatttgtagagaaaggacacaaggaaaatattttgcccttgcccggtgctgtggatgtcatatgtggtgggcctccatgtcaaggcatcagtgggttcaaccgattcagaaagcataatgatccacttgaggatgaaaagaacaaacagttggttgtttttatggatatagtgaagtatctgaggcccaaatatgtcctcatggaaaatgttgtggacatattgaaatttgcagatggattccttggacgctatgcaatgagttgccttgtggctatgaattatcaagctaggcttgggatgatggcggcaggatattatgggctaccgcagttcagaatgcgggcatttctctggggagcccttccatcaatggtattaccaaaattcccacttcctacccatgatgctgttgtgcgtggaatagtaccaactacattttcgcaaagtgttgttgcatacaatgaggtagacacccgttgcctacgaaaggctcttctccttgcagatgccatatctgatttacccaaggttggaaatgatcaacctaaagatgtaatagagtatagtgttgcccccaaaactgaatttcaacggtatatccggaacaaccgtaaagacattcaggattactcttttcgtggagatgatccttctgaagaaggtaaattgtttgatcatcaacctctaaagctaaacaaagatgattatgagcgtgtgcagcggatacctgtaaaaaagggagcgaactttcgtgatctaaagggcgtcatagttggcccagataatactgtgcggctggatccaaacatttcccgtgaacgactgtcatctgggaagcctttggtgcctgactatgccatatctttcgtcaaggggaagtcaactaaaccgtttggacgcctgtggtgggatgaaactgttcccactgtagttaccagagctgagcctcacaaccagattattttgcatcctagccaagaccgagttctgactattcgcgagaatgcaaggttgcaaggttttcctgactattacagattgatcggcccactaaaggagaaatatatccaggttggcaatgcggttgcaattccagttgctcgagctttggggtatgctcttgggctggcctaccggggtgaatctgatggagatcgagcagtactcaaattgccagagagttttatttatgctgatcaagagacggttgttaaatcttcggcaggaactcctggaagtgaaatagctgattcggaacagttgtttgaatatttcataaaccccaatttcttttgcatgatgtttgcttttcttaaagtgaatgtggttattcccttgatcctagattctaagatgggtttatcgcgacgaggagccgaggagggggaggcgcgccgcgccgttccattccagaacatcctctcgtgggaggggtggaatcgtcttgatcatcgccggggcgagatccgtctcgacgtccggcgggaaatggacgattccccgctagataatctgtttgatggaaatggattggattcatcggcaggcgcggacagctctagctccacgggatcaccgccgagctccacgtcgtcgtcccctccgtcgtcgcagtcacctcctccggggtcatcgccgcctcctgccagcccgccaccgtccacaccgtcggccccaccgaccaattcctcgggctcagcaccgtcgccaccttccccgtcgcagtcggcgccaccggcgaataccggcggcggcgggtccccaccaccatcgcatggctcgccgccagcgccaaaggccgtccagtctcaacccgctccgaagcgtagcggcgacggtggctcctcctcggacagtgggagctccaaggagggaggcagctcgagtgaccgtggcaagagcgaaagcaacggcaacaggccggggccagaggctgccatcatcgccggcatggtcatcgggttcttcaccttcgccctgctgctggccatcgtcgcctgcgtgtgctgctccaagaagaagaagagacctccccacatgcacatgccgtactacaccgacgagaacgggaaagtgtactacgcgaacagcatgcccaggtggcagaacagcgtggaccaaggcggcggctggcacgcgcagtactcgccaggccaggcgccgccgagcagcgagatgagcgggtcgcacggggcggggccgctgccgccgccgtcaccgggcatggcgctggggttctcgaagagctccttctcgtacgacgagctggcgctggcgacgggcgggttctcgtcggcgaacctgctggggcagggcgggttcgggtacgtgtacaggggcgtcctcgcgggcagcggcaaggaggtggcggtgaagcagctcaaggccgggagcgggcagggcgagcgcgagttccaggccgaggtggagatcatcagccgtgtccaccaccgccacctcgtctccctcgtcggctactgcatcgccggctcatcccagcgcctcctcgtctacgagttcgtccccaacgacacccttgagcaccacctccacggtctccatatctttcctgctcttttcccagccatcgtaacgcgccattcggaagggcgtgccggtgatggcctggacgacgaggctcgccatcgcgctcggctcagccaagggcctcgcgtaccttcacgaagatttctgcagggacaaatcctgtctgtacgtccttctaacgatctgatttgttgcattgtggttgtcacgtacgaaggccatcctaggatcatccaccgtgacatcaaggcggccaacatcctcttggacgagaatttcgatgctaaggttgcggatttcgggcttgcaaagctaaccacggacaccaacacgcatgtctcaacgcgcgtcatggggactttcgggtatctggctcccgagtacgcgtcgagcggcaagctgacggacaaatcggacgtcttctccttcggcgtcatgctgctcgagctgatcaccggccggcgaccggtcgacccaacgaactacatggaggacagcttggttgactgggcgaggcccctcctggcgcgcgccttgtcggaggacggcagtttcgacgagctgatcgaccagcgcctggagaacaagttcgaccggctggagatggagcgcatggccgcatgcgctgccgccgccgtccgccactccgccaagcgccgcccaaagatgaagcagattgtccgtgcgctggagggcgacgcgtcgctggacgacctgaacgaaggggtgaagcccgggcagagcatgatgttcagcacggggtcggagtacgactccggcaactacgcttccgacatcaacaggttgaggaaggtggccttcgagagcagcatcgaggacagcagcgagtacgggacccactccagcgccgactcgggggagccaccccggcggcaacagcatcgctagccgtatgatcggaggcgtcgagctagacttgactatttcttcggtgcgtgagtgtggaaagtggaaactgtgtggtgttgcgagatggcgaatcatcgatgggaaccggggcgtaccgtgtatgtgggaattgggatactgtcgtgcatattgcaggccgatcgtttgacgtgactgctttgttggctgtattatcgtgtgatttaatgatgtatccgatcgatgagtaatgcgatattgcgcttatcttgcatata

SEQ ID NO: 878 - DNA, 1472 bp, Oryza sativa
agggttgaaagcatgtttgaaaaagtgaaagcaaaccttcctggtcctcctgaatttttgctgtgtgttttaccagaaaggaaaaattgtgatctctatgggccatggaagaagaaaaaccttcatgagatgggtattattactcaatgcattgttcctagtgttaagatgaatgatcagtactataccaatgttcttctgaaaatcaatgctaagcttggtggaatgaactccaagctttcattggagcatcgacatatgattcccattgtcaatcaaacacccacattaattttgggaatggatgtttcacatggttcgccaggtcgagctgatgtaccatcaattgctgcggttgttgggtccagatgttggccgctgatatcacgctacagagcatctgtccggacccagtctccaaaggtagagatgattgattctctttttaagccactggacgatggaaaagatgatggcataataagggaacttctactggacttctacaagaccagtcaacaaagaaagccgaagcagataatcattttcagggatggtgtgagcgagtctcaatttagccaagtactgaatgttgagcttaatcaaattataaaggcatatcaatatatggatcaggggccaattcctaagttcacagtgatcattgctcaaaagaatcaccacacaaaacttttccaagaaaatactccagacaacgttcctccagggactgttgtagattctggtattgttcatccaagacagtatgatttctacatgtatgctcatgctggacctataggtacctcaaggcccacccattaccatgtcttgctcgatgagattggtttcttgcccgatgacgtgcagaaactagttttgtcgctttcttatgtgtatcagaggagcaccactgcaatatctgttgtggcacctatctgttatgctcatctcgcagcagcgcagatgggccagttcatgaaattcgaggaattcgctgagacttcgtctggaagtggtggtgtcccttcgtcatcaggagcagtggtcccagagttgccgcgcctgcatgctgatgtctgcagttcgatgttcttttgttgaggtggtgttagtcagctagtgtgcagcagggctgatccttcttttttttttgaaggaaccaaatacggagtacttgttaggcacttttgtagtactctagattgatactatgagatacatctaggttgggtagggagcatttttttttagatgatatagtgctcctaatgatatagttctgttagtgctcagctattaggaagtaaaggcttacccttgatggtaggtttatgaattcaagacgctaactttgcgccatatctaattgtcaaccagttaaacagatgattcgcacatgcctgtttcgctctcagttgtatccgcatcttattttttgcatttttttcatatatttgcaccatcgtgat

SEQ ID NO: 879 - DNA, 3528 bp, Oryza sativa
atcaaccctctctctctctctctctctgcctcggcgacctcgcctccgcttactctcccacccagacaaaaccctctttgcctctcatggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagatggcgttcgccctgctatggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtgagtttgagtcccccaccaaagaccaggcgcatcaacagggtagtgatgtctgagctggccaggttgcaccgtgagtcgcatctcggtggcataagcttcgcgtacgacggaagcaaggccctgtacactgcaggaaaactgccgttcgactccatggacttcaagatcaagctgggcaaagagctcagggaaatcgagtacaaggtgacaattcgacgtgctggccaagcagatctgcaccacctgcacgagttcatcgccggccggcagagggactctcagcagcaaacgatccaagcactggacgttgtactgagggagtcaccttctctgaactatgtcatcgtttctcggtcgttctactccactatgttcggccgacaagacattggtgatgggctggaatgctggaaaggatactatcagagcctgcgcccaactcagatgggactctcattgaacatagacatatcctctaccccattcttcaaacctatcagcgtggtagaatatgtcaagaattgtctgggcacacctactaatgctaatggccctgaccctaggcggcctctttctgacattgatcgcctgaaggttaagaaagcactacggggagttcgtgttgaaacaacacaccaggggaagagcagcaagtacaagatcactacgattacatctgagccactgagtcagctgaacttttctatggatggaactacccagactgttattcagtacttctcgcagcggtacaaatacaggctgcagtacacgtcttggccctgtctgcaatccggcaacccttctaaccctatatatttgccaatggaggtatgcaccattgtagaagggcaaagatactccaagaagctcaatgacaaacaagtgactggcctcctgagagcaacatgccagcctccccagaaaagggagcagaaaatcattgagatggttcaacacaacaactacccggctgataaggtggtgagtgattttagaattaatatttccaatcagatggccactatgccagctcgcgtgctgcctgcgcccacgctgagataccatgactctggaaaggagaaaacttgtaatcccagagttgggcaatggaatatgatcaataagaaaatggttggtggagctgtggttcaaaagtggacttgcgtgaatttttcacgcatgcatattgatgccgtgcacagactatgcggcgaactagtttatacatgcaatgctattggcatggttttcaatgaaatgccagagatagaggtggggtcagctgctcctaataacatcgaagctgccctgagcaacattcacacaagggctcctcaactccagctgctcattgtgattctcccagatgttaatgggtattatggaagaattaagagggtgtgtgagactgaacttgggatagtatcccagtgcctcaagccaggccgcaagctcttgagcttagacaggcagttcctggaaaatgtctcactcaaaatcaatgtcaaggctggaggacgcaactcagttcttcagagacctcttgtacccggtgggcttgaaaacacaacaataatttttggtgccgatgtcacccatcctgcttctggagaggactcatcggcgtcgatcgcagctgtggtggcctccatggactggcctgagatcaccaagtacaaagccctcgtctctgcccagccacctcggcaggagattatacaagatctcttcaccatgactgaagttgcgcagaatgctgatgctccagcacagaaggctgaaggttcgaagaagaatttcatatgcggcggaatgttcagggagttgcttatgtcattctacagtaagaatgctaaacgtaagcctcaaaggataatattttacagggatggtgtaagtgatggacaattccttcatgttctgctctatgagatggacgcaatcaagaaggctattgcatctttggacccagcatacaggcccctggtgacatttgtggttgtccagaagaggcaccacacaaggctcttccctgaggtgcatggaaggcaagatctgacggacagaagtggaaatgttcgtccaggaaccgtggttgacactaacatttgccaccctagtgagttcgacttctacctgtgcagccatgccggaatccagggaacaagcagaccaacccactaccacgttctccatgacgagaaccgttttagtgccgatcagctgcagatgctcacttacaatttgtgttacacctacgctcgatgcacccggtctgtctctgttgtccctccagcctactacgctcacctggcagcattccgggcgaggtactacgatgagccccccgccatggacggagcttcgtcggtcggcagcggcggcaaccaggcggcggccggcggccagccaccggcggtgcgccgcctcccgcagatcaaggagaacgtcaaggacgtgatgttctactgctgatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgctactcgatagttgtatgtttctcgaagtgtatttttttggggttatgtgtgatgtttgaaagacaggtcatgatctaaattatttctgcggattagttgacatgccatgatctaaa

SEQ ID NO: 880 - DNA, 3452 bp, Oryza sativa
ctcacccactccccaccccttcccaaaccctcacctccatctcgttgccttcctccacctctctctctgccatggcctaccgcggcggaggccgaggtggccgcggcggcgagcagcggccgccctactccggccgcggcgacgtccctggccgtggtggcggtggtggtgggggtggagccccgccgtaccgtcccgcctcgggcttcgtgtggccgccgccggggatgacgccgcggccggggcctcctcagccgcagtacccgcggccggggccgccggccgtcgtctacggcgcgccgatgccggcggcgcaccaccagggcgcgtaccagcccgggggcgtgtaccgtgcgccctccccgggggttccggtgatcggtggctacgcgcgcagcacgcccgtcaccatccgggcgcctccgccgtcgcactcgtcggctccggctccgtaccagccggcggcggccgcgccggctccctcgtcgtcctccacggcgccgtccgctacggctctggccaaggagttcgagcagaagctgttcgtgtcggagaccgcgctggcgccacccgcggcggtggcgtcggccgcggccgcgccggctggcgaggcgtcggtggagtcggacaaggatctggcaccggtgtcgaagaaggggctcgcccaccctgcgcggccggggttcggagcggccgggaagaaggtgatgatccgcgcgaaccacttcctcgtcaatgtcgccgacaacaacctcttccactacgatgtttcaatcaatcctgagtcaaaatcaagagcaacaaatagggaagtactcaatgagctcatcaagttgcacgggaagacatctcttggtggcaaattgcctgcctatgatggaagaaagagtctctatactgctggttcactcccttttgaatcggaggagtttgtggttaagctaattgatcccgaaaagaaggataaagaaagggcggagagggagtacaagatcacaattcggattgctggcagaacagacttgtaccacctccagcagtttttgcttggaagacagagggatatgccccaagaaaccattcaagttcttgatgttgtccttagggagtcaccatcttggaattatgtcacagtgtccagatccttcttctctacccagtttggtcaccggggtgacattggtgagggacttgagtgttggagaggttactatcagagcctgcgcccaacacagatgggcctttcgctgaatatagatatatctgcaacgtccttttttaagcctgtgacagtgatccaatttgtggaggagttcctgaacatacgtgacacctcaagacctttgtcagaccgggatcgtgtgaagataaagaaagcattacgtggggttcgcattgaaacaaaccaccaagaggaccaaatcagaagatacaagataacagggattacccccattcctatgagccagctgatatttcctgttgatgataatgggacaaggaagactgttgttcagtacttctgggataggtacaattacagactgaagtacgcttcttggccctgcctacagtctggcagtgattctcgccctgtatacttacctatggaggtgtgcaagattgtagaagggcagaggtactccaagaagcttaatgacaaacaagtgaccaacatccttagagcaacctgtcaacgcccccagcagagggaacagagcattcatgagatggttctccacaacaagtatacagaggataggtttgctcaggagttcggtatcaaggtctgcaatgacctagtctctgttccagcccgtgtgctgcctccacccatgttgaagtatcatgattctggaagggagaaaacttgtgcacccagtgttggacagtggaacatgattaacaagaaaatgatcaatggaggaactgtggataactggacatgtctgagtttttcacgaatgcgtcctgaggaggtacaaaggttctgtggtgacctgattcagatgtgcaatgccactggaatgtctttcaatccaagaccagtcgtggatgtccggtcaacaaatcctaacaatatagagaatgctctgagggatgttcacaggagaacatcagaactgctagccagagagggaaagggaggcctgcagcttttaattgtaattctgcctgaagttagtggttcttatgggaaaattaaaagggtctgtgagactgaccttggcattgtatctcaatgttgtttgccaaggcatgccagcaggccgaacaagcaatatttggaaaatgttgcactcaaaatcaatgtcaaggtcggagggcgcaacactgttcttgagcgagcctttatccgcaatggcataccatttgtgtcagaagtcccaacaatcatctttggcgctgatgtcacacaccctccacctggagaggactctgcatcatctattgctgcggttgtggcatctatggattggcctgaaatcaccaaataccgaggtctggtctctgctcaaccacatagacaggagataatagaagatctctttagtgttggtaaagatccagtgaaggttgtaaatggtgggatgatcagggagttgcttatcgcattccgcaagaagactggcagaaggcctgagaggataatcttctatagagatggtgtaagtgaaggtcagttcagccatgtgcttcttcatgaaatggatgccatcagaaaggcttgtgcatctttggaggagggatatctaccacctgtcacatttgtagtagttcagaaaaggcatcacacaaggcttttcccagaggttcatgggaggcgagacatgactgacaagagcggaaacatccttcctggaactgtcgtggaccgtcagatttgccatcctacagagttcgatttctacctgtgtagccatgctggcatacagggtactagcaggccaactcattaccatgtcctttacgatgagaaccattttacagccgatgcacttcagtccctgaccaacaatctttgctatacctatgcgcgatgcacccgggcagtgtctgtggtcccaccggcctactatgctcatcttgctgcattccgcgctcgctactacgtggaaggagagagttcggatggtggctcgacccctggcagcagcgggcaggctgtggcgcgagagggccctgtggaggtgcgccagcttcccaagatcaaggagaacgtcaaggacgtcatgttctactgctgaggagattgttggcaaggagagcccaatattctggtagttttttggttggtagacttgtttgtgtccttggtttggagctggttgcttgtagttccatttgctgtttccgagtagccggattgtgactgagcttttgtggtctttaaggccttaactctgcttgagacaatgcaagtcttttaaatttccctgtggcttttgtta

SEQ ID NO: 881 - DNA, 3193 bp, Oryza sativa
atggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacgggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtatgtctcgatagggcggtcgttctactcgccggacataaggaagccgcagcggctcggcgatggcctacagtcatggtgtgggttctaccagagcatccggccgactcagatggggttgtcgcttaacattgatatgtcatctaccgcgttcatcgagccgctaccagtgatcgaattcgtggcccaaatactagggaaggatgtcatatcgaggccattgtcggatgcaaacagaatcaagatcaagaaagccttgcggggcgtgaaagttgaagtcactcaccggggaaatgtgaggcggaagtatcgcatttcagggctgacaacacaaccaactcatgaactgattttcccaatcgatgaccaaatgaacatgaaatctgtcgtagagtatttcaaggaaatgtatggcttcaccattcagcatccccatcttccctgccttcaggtgggaaaccaaaagaaggcaaactatctaccaatggaggcctgtaagattgttgagggtcagagatatacaaagaggttgaatgaaaagcagatcacatcattactcaaggttacttgccgtaggcctagagaacaggagatggatattctacagacagttcaacaaaatggatatgagcaagacccttatgcaaaagaatttggaatcaacattagtgagaagctaacctcagttgaagctcgggtccttcctgcaccttggctgaaatatcatgatactgggaaggaaaaggagtgcttgccacaagttggtcagtggaacatggtgaacaagaaagtgataaatgggtgcaaggtgaatcattgggcttgtataaatttctcaaggagtgtgcaagaaactactgctcggggattctgccaggagttggcacaaatgtgtcagatatccggcatggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgatataaaacgtatatgtgaaactgacttggggttgatatcacaatgttgcttaaccaaacatgttttcaagatcagcaagcagtacctggcaaatgtctcacttaaaatcaatgttaagatgggaggaagaaacaccgtgctgctggatgcaataagttggaggattcctttggtcagtgacataccaactattatatttggtgcagatgtcacgcatcctgaaaccggggaggactctagcccatccattgctgctgttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcagggagctcttaatatccttcaggaaggccactgggcaaaagccattgagaataattttctacagggatggtgtcagtgaaggccaattctaccaagttctcctctatgagttggatgctatccgcaaggcatgtgcatctctagaaccaaattatcagcctcctgtaacattcgtggttgtccaaaagcgtcaccatacaagactcttcgcaaacaatcacaaagacagaagtagcacggacaaaagtggaaacattttgcctggaactgttgttgattcaaagatctgccacccatcagagtttgatttctacctctgtagccatgctggaattcagggaacaagtaggccagctcactaccacgtcctttgggatgagaacaatttcactgcagacgaaatgcagacattgacaaacaacctttgctacacttatgcacggtgcacacgctctgtttctgttgttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcagagcaagcatttggatcctgagcgacctcttttgaccactctgtaaagtactaagtaacgcatgtataatagttgttgtatcagtctgaaaaaaaggaagtgcactcagtgcttgtttttccagttctaggatgattttctcttcatggttaagatctggtaagagactc

SEQ ID NO: 882 - DNA, 3602 bp, Oryza sativa
gtcctcgaatccctctgctcactaccgtcgcgctcgcttatattgcgggagtcggcgacgaaaaccaccgagcacccgtcggcgcagcagcggcggagcgaagggaagggaagggaagccgcgatccagccgccgtcgactcgccgcccacgcagtcgccgccgagccccatctccgccactgctcgttgtgatatgcgccatgggtgtcaagactttacaggtatcagggtttgctctagatgacagtgctgattacgtcaaggatttgttggagcgaattgttggctgtgggaatgtgtatgcagtaaagctcaggcatccaaagaacgtcactgctacctcaagagcatatgctatagttcagtttcagaccgaggaacatgcttcacttgtaaaaaatgcggctcaaagaaagatactccgccgtgggcattattatctgaaagtccatccttcagatcgtgacattgttccaagaccaagagtttcaatgttcaagctagaggatgtaacactgcattttggttgcctgcttaaggaaacaattttatctgctctgtggagtcgaaaaggagtttctgttgagtttggtttcaatctgaaaaagatttacttttacctgcagctacccaacagctcaatcgaatataaacttgaactttcccatgagagcatatgggagatccagcttcaacgcccacccaagtcacaaacgaagtttcttttgatccaggttcaagctgcacctaagatttatgaacagacaccacgccgttctggtgttatgtacgaagatccattattcaactattttagggatcatacagatgatcaatggaccaggacaacggattttacttcatcttctagcattgggcaatcatatattttatgtcttgaggtaccacgtcgatgtgatctcccaaacattcgtgactacttcttttactatcatgagtacaatcatgacttcgagtgccggagtggggggtatccatattcaagtgatactcgctttgttccgattgtgaaatctcgtggttatgtcccctatgagatactcttcaagatcaaccatttggttcagaatgggacacttagcggaccgacagttgatgacagcttctttcgtctggtcagcccagcttttgtacctattgaccatataaagcgtgcacttgaaatgatgtcatatttgaaaaagacctgcttgaatccaacaagttggctatctgaacaatactcaaaattccggagatcacgctacgtccaaccatcacctaacatatctctggatgatggattggtttatgtctacagtgtatttttatggacctgagattaatgtctccaatcgtgtggtgcggaatttttcttctgacatagagaatttccttcgcatttcatttgttgacgaggactgcgagaagctccgtgcaactgatttatccccccgttctgcttcaggacatgatgcaaacagaactgctctgtataagagagttctgtcagtcctttcagatggcatcactattggtggcaagaactttgagtttcttgctttttcttcaagccagctccgagataactctgcatggatgtttgcttctcgccagggattagctgctagcgacattaggacatggatgggggatttccgtaacatcagaaatgtagcaaaatatgctgcaagacttggtcagtcttttagttcctcaaccgaaacattaaaggttcagaagtatgaggtggaagaaatctcagatataaaaaatggtacacagcatgtgttctctgatgggattggaaagatatcatctgcttttgctaatgaagtggccatgaagtgcaacctgaaacgctttgctccttctgcttttcaaataaggtatggtggttataaaggtgttgttgctgttgaccctacatcacgctggaagctttccttaagaaaaagcatgctaaagtttcagtcagacaatatcacagtagatgtccttgcatacagcaagtaccagccaggcttccttaatcggcagctaattactcttctttcgacacttggagttagagatagtgtctttgaacagaagcaagaagaagcagtgaatcagttgaacaaaatggttactgatcctcaagctgctatcgaagcaattgaacttatgcccatgggagaaataacaaatgcagttaaagagctgttgttgtgtggctaccagcctgatgatgaaccatatctttctatgctgctacaaacttttagggcatccaaattactagagctgaaaaccaagtcaaggatattaatcccaaaaggacgagcaatgatgggatgcttggatgaaacacgtacgctgaagtatgggcaagtgttcattcgagctacttcgggtgtaaatgacaatgacaggttcaccgtgacaggaaaagttgtgattgccaaaaacccttgcctccacccaggtgatatacggattctccatgctgttgatgttcctgttttgcaccacatgtttaactgtgtcgtctttccacagcaaggaccaaggccgcatcctaatgagtgttcagggagtgatcttgacggggacatatattttgtttcttgggacccatctctcattccgcctcgtatggtgacacctatggactatactccagcaccaacagaaacattagaccatgatgttacaattgaggaagtagaagagtacttcacaaattacatagtcaatgagagtttaggaatgattgccaatgcacatgtagtatttgcggataaggaagacctcaaggcagagagttcaccatgcattgagctggccaagctcttctccattgctgttgactttcccaaaactggagtgccagccctgattcctcctgaactacatgtgaaggagtatcctgatttcatggagaagcttgacaaagtcacctatgaatcaaaaggagtaatcgggaagctctacagggaaataaagaagcacacccctcacataaagcacttcacaagggaggtggcaaggcggtcttatgacaccgatatgattgttgatggctatgaagattacatcactgaagctatggcattgaaggacgagtacgacttcaaattgggtaatcttatggatcactatggaataaaaagtgaggccgagataataagtggatgcattcttaagatggcaaagaatttcacaaagaaaagcgatgctgatgctatcagattggcggtgagatctttgcgtaaggaagcaaggtcaaggttcagtgagatgagcttagatgataatgggcatggccatgatgcctccgaagccaaggcatccgcctggtaccatgtcacttaccaccctgaattctggggttgctacaatgaaggatatgagcgaccacactttatcagctttccatggtgtatctatgagaagcttttgcgcattaagcaaaggaggaagttcgtcaggaagatgcagcccgagttgttctctctccacaacttgagaatttgagtgtggccagcatgtttgctcttatacatatatctgaacttttgcattgaacatgtctattctggtgcttgaatgcttactg

SEQ ID NO: 883 - DNA, 9198 bp, Oryza sativa
tgcatacttactttcttgccaaattgagcgaggtgaactcgcttaatatcctccgccaacgcctaatgcatatagcctagttcccacccatatgtaactcccatccccatcattcccaccctctaaatgatgtactgcctaaccttattctattctcttcttatgccgtggcccccaagtcaattatcatatcctcgtattttcaatcacactatgacactcacttctactccctccccgtgtgatgccttctcttctttacaatgtcttggatagatctatacaaacatgatggatataataaatctatctaaatgattagagaaatatcgactcgtcataatatcagacctaatcgagaaagtcctaactaagctgatatgactctaaatagggatgaagttaaaaataaaaccaatatatcaaatagacaacgcttgcgccaacctgaatagaatatcagacttaaccgaaaaagttctagtcacgctgatacaagcaaagttgacagaacttacttccttgccggagatcaaaaccgatgcagcccaactcgaaattaagaactcgccagaataaaaggtgatggtgcaccgaaagtaattgtattgatatgtaaagatgtcttacatagtctctaggtgtacatatttatacctttgtattgatacaagtcgtgattggagaccacacatgtttcctaaagataaaagaaaagatacgagtcatccgatactagaagaaactttctaatctaaagataaaatataaaattactaaatcatgtctaattaataaataaaattaaaccgttatgtcgtggtcttcatgatttctttttgaacttggtctattctaaataagcttcgatctaccaattgagttctttgcttaaccgaatcaattagagaatcgtactaaattttgacatgggctgtgtttagttccttggccaaatatttttgaagtatacggacacacatttgaagtattaaacgttgtctaataacaaaacaaattaaagattccacctgtaaattgcgagacgaaatcattaagcctaattaatccatcattagcaaatgtttacttcaccatcacattgtcaaatcatggcgtaattatgctcaaaagattcatctcgcaatttacatacaaattgtgcaattatttttttcgtccacatttaatgcttcatgcgtgtgtccaaatattaggtgtgacgtttttggaaaaaaaaaagttgaatctaaacatggcccatggacataggccgtgtttagttccatttcaatttttttaagtatacggacacacatttaaaatattaaacgtaaactaataaaaaacaaattattccgatgaatctactcatcctaattaacccgtctttagcctaattaattcccaacggagcctttgttgtatttttattcctgagtaacgctgacacgtgggtcacagtcattagaaaacttttgagataaaaggcggagtagtagtcagtagtactcgagtatctccccattcctcctcgcgtaaaagaaaatctcccgtctcgtcgtctccgttccttgcgccatctcgcggctgaacaggggtcgcgagcagagcaggggatcctggtgagcatccgcatcctctttctgattcatctctctctctcccaccgggactacttttttctggaatttgcttgcgttcgtcaatcctagcttctcttctaaatcttggaagaagctcttctcttcttttcagcgccataaccttaatacaagtaacaatctgtttgttccccaaaaagtttgagggtttaactgaacccctatgtctcaagttggatccgctcctgtaacgtttcccccttaaaaattttttttgggggttcaactaaaccctaggtttattggtatctggtgagtagtatgtacttgcatgatatagatctatatatgtattggtttcttgcaaccagtttgtgaatacgctcttgtatccgcttcttgcaatatcccatctcttcccgtaacaatggtgcattcgccttcttgctcaaatatggggttttgtttcttttgtttttttttatccccaaatgtagttggttgtcgatgcttcttgtggggggcatgccttttaatctgtttggtttgatttaaaatttctccctgaagggtcaatgtgctgtgcttaagtttcttggttcaaaaggtcatggggggcatgccttttagtctgtttggtttgatttaaaatttctccctggagggtcaatatgctgtgcttaagtttcttggttcaaaaggtcatgtttttaactccactgttgtgtacaagttcttcagtttgctactcgatggagagttaatgtgctgagcttaggtttcttggtttataagttcgtctttttaattcacctattgtatacaatacaagaccttcaggttgctactccctggggggtttgaaccaagaaatgccgtacggcacattgacttttcaaggagtagaaagccgaagggttttcatacaatagttgaattaaaaagatgaacttttgaaacaagaaacctaaggacaacacaagttcttcagtttcttggttcaaaatagttccatccttttaattcaactatattgtatacatgcccttcaggttgctattagtactccctgaagggtcaatgtgctgttcttataggtttcttggttcaaaagttcgactttttaattcaactattgtataaaagcccttcagcttgctactctctgagaagtcaatgtgctgtactgcatttcttggataaaaaaaaatcgatagtttgtctttttaactcaaatgttgtatacaagctcttcagtttgctatgtcctggagggccaatttgccgtgcttaaggctcttggttcaaaagtttgtcttttaactcaaatgttgtatacaagcgcttcaagttggtctgatttgaaatttctttttgaaaagaagtgtgatttagaccataggctcccccttctcagctgataggcatgaaaacaacaatgaaaagaattcttgtggaggcctgcttttattccgattgctgtgattcaaatttatccctagagggttaaatggttaatgcgcttgcttagtttgtttggttcaaaagtcctttctttttaactcaagtgctgtatacaagcttttattctggtacgatttaaaatttcttttcagtaagtgtgatttagaccgaaggctaccccttttcagctgatacatgcattaaaacaacaaaagattaacttctcaaggcagtaatcactacaatacatgcaactaataacaatagggtggattcggttggagaatgagccaaactttcttaaaaaggaattgccgtaatacaggttttgcgcttaaaagcttttaatctgctgctgcaagcaattatatctggctggtttgttaatgattacaattgttttgttacctcccttttttatttattcagcaacaaaactttccgtattgatgcaactgtcattgcattattgaattcaacatgttgaatataatgtgtttatcacattgatgtcaattcctcaaaggggtaatctcccctattgtaacattgattaatccccctatttgcagctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgtaggtttctattctaatttattatcttatattcaatttatgggaattcataaccataatcaacatatgtacctggctgatttctagttctgtggtactttattaataggttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagttagtttatccttgatttgtttttttgctgtttgtgctttcctaatattatgtttggtattatgtcttgtttaactatttcttgtttataggactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagtatgtttctccacaagtgcattatccctgtgatttaaaagtgctctgctgtatttgggtttttgtatgctctataccaccgtgtcaaccacaagtgtatcacctcatgactgcattaattttttttcactatctacaggggctgccttttagtacgccagtcatttttccacaacaatcctaataactttgttgacctgggtggtggtgtgatgggctgtcgaggattccattcaagtttccgtggcacacagagtggactttctctgaatatcggtttgtattttgtcctgacatatcgttgtgcaattgcattgtttatcggtttgtattttgtcctgacatatcgttgtgcaattgcattgtttatttgtggtccttacataatcctatatttaagtaatcttcctgaattttcagatgtttcgacaactatgattgttaaacctggtcctgttatcgattttcttcttgccaaccagaaagttgatcaccctgacagaattgattggcaaaaggtgagctttttatttaatatcattgatgtttatgtgttagtaatcatccaaccatattggtacattcttacttggatgttttcttgctcaatacaggccaagcgtgctctcaagaacttgaggataagaaccacccctgtgaattcagaattcaagatcattggtttgagtgacagaaattgcaacgaacagatgtgagagcatattcttccttgctattttattcatctaaagcaattcttaaattaatattttggaaaaggcacccaattgttttgagcttgtattgcagtttttttcctaatcattctgctattatcgattgctttctgattggcatgcttgactaggttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagaggtctgtttaatttttgctattctacatgtttaaaaaagtttactagaattatttattatttcaaactcctgttgtgaatattcttgtattaccagctatgctctcttattccactacaaagatacaccaaagctttgtcaacactgcaaaggtcctcccttgttgagaaatccagacagaagccccaggaaagaatgtcagtccttaatgatgtgagttactattcttgattctaacctgctacaatcatatagaaatggttggaattgtcaacatgactggtaagtgacgattcatgtttaccctaaatgcaaggcacttcgacatagtaattatgattctgatcccatgttgagggcatctggcatttcaattgcccaaaattttactcaagttgaaggaagggtcctgcaacccccaaaggttggtgaggattctctgaattcgtatgttttcacatgctccatgttctattcaacgtaccgcgtctaagtatatattgtatcatgtagctgaaagctggcaatggtgaagatatattcccacgcaatggtcggtggaacttcaacaataaggtcagaatgattttctttatcatatctttattcttggtatggaggaggtcgaggaacattctgatttctttcccttttttcagaaactgattcagacctgttctgtcgataagtgggcagtagttaatttctctgcacgctgtgatgtgcgaaatcttatccgggacctcataagaaatgcatctgcgaaggggattgtatgttttagctttttatcacatattttacgcctgatatttctttgcactgaactttgttaactttgcagcaaatggccgaaccttttgatgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggttcgtcattgtttccactccctaaagtcattcactcccttgcaaaatttacattgttttgtttcaaccaggtccttggaagaggaagtgtcttgctgaattcggtattgtcacacaatgccttgctccacaaagagtcaatgatcagtacctactcaatttgctattgaagataaatgccaaggtatttaacgtaaccttgtcttttcttactgcattatccatttatgtaagcttatggacttgctcttcccctgttactaaccagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtaagagggatatacttttactctcataactccacacactgaactgttgtagctcatgtcatatgcatggatttctcaatttctaagttggggtgcttaattggttattgtatacctttggagttgtttaggtggttagctctcgccaatggcctctcatctctaaatacagagcatcggtgcacactcagtcacctaagctagaaatgatgtcttccttgtttaagccacgaggaactgaagatgatggcctcattcggtaagagatattatttgataaaccattgttgccaatgtatactatgattgctcacaagtatcctttctatagatgcttatctttgcatttgggatttttcagggaatcgctgattgacttctacactagttctggaaaacggaaaccggatcatgttatcgttttcaggtttcgagttcaaaaattgttgtctgtgaatctctctgaattctgtagtaatatcttagatgttcatttactcaaattgttaactgaagctgtcccagcaactgatgtaaatactttctattttttagggatggagttagtgaaagccagtttactcaggtcattaacattgagcttgatcagatcattgaggtgtgtgtttatttcattagccctcccatacctgctactgcacgtccaacttctgtactcaccaagtagtagctatgccctattgctcatttttctttaaatgtaacctattgcccatcgctttcattgttttgcttttaattgatgcagctcatcaagtagtaattatgcctaggactcatctgaaaaatatcacatattgtgcatcactgtttctttggcttttaatcaatgcaggcatgcaaatttctcgatgagaagtggtcaccaaagttcacagtgattgttgctcagaagaatcatcataccaaattttttcagtctggatctccagataatgttccgccaggtaactctttaggcagttttctctgatacctatgttatatcattttactgtgatgaaatcatggcgaggctaaagataaatggtaaacggccttctgtaggtactgttgtggacaaacaagtgtgccatccaaggaattatgacttctacatgtgtgctcatgctggaatgattgtaagctatctctggtttccacctgcagtgcacttattgtgagctcattgctttgtatgctctccgttgcttgtgtttataagatgtttgttgtttcagggaacgacgaggccaacacattatcatgttctgcacgatgagataggtttctcccctgatgatctgcaggagctagtgcactcactctcttatgtgtatgttgaaaactgcactggcatttcatccctgcgatctgttagctagttctgttctgatttgctgcctgtgtccatttcaggtatcagagaagcacaacagccatatcagttggtatgtagcttgtaaattgtaatgccatttctagttctcttcgggtaagatcactgtactgtcctgttggtgcctgaccttgcgcatttgtgtgcagttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagtatctgatctgttcgaggttggggatgaatgaccaaggaaatctttccttgtggttatcatgacatcattgatatcctcaggattactcatcatcagtttactgacgggtaaaatataactggcatggatgaaattatgacgattttcttcccacaac

SEQ ID NO: 884 - DNA, 9074 bp, Oryza sativa
aaatgatgtactgcctaaccttattctattctcttcttatgccgtggcccccaagtcaattatcatatcctcgtattttcaatcacactatgacactcacttctactccctccccgtgtgatgccttctcttctttacaatgtcttggatagatctatacaaacatgatggatataataaatctatctaaatgattagagaaatatcgactcgtcataatatcagacctaatcgagaaagtcctaactaagctgatatgactctaaatagggatgaagttaaaaataaaaccaatatatcaaatagacaacgcttgcgccaacctgaatagaatatcagacttaaccgaaaaagttctagtcacgctgatacaagcaaagttgacagaacttacttccttgccggagatcaaaaccgatgcagcccaactcgaaattaagaactcgccagaataaaaggtgatggtgcaccgaaagtaattgtattgatatgtaaagatgtcttacatagtctctaggtgtacatatttatacctttgtattgatacaagtcgtgattggagaccacacatgtttcctaaagataaaagaaaagatacgagtcatccgatactagaagaaactttctaatctaaagataaaatataaaattactaaatcatgtctaattaataaataaaattaaaccgttatgtcgtggtcttcatgatttctttttgaacttggtctattctaaataagcttcgatctaccaattgagttctttgcttaaccgaatcaattagagaatcgtactaaattttgacatgggctgtgtttagttccttggccaaatatttttgaagtatacggacacacatttgaagtattaaacgttgtctaataacaaaacaaattaaagattccacctgtaaattgcgagacgaaatcattaagcctaattaatccatcattagcaaatgtttacttcaccatcacattgtcaaatcatggcgtaattatgctcaaaagattcatctcgcaatttacatacaaattgtgcaattatttttttcgtccacatttaatgcttcatgcgtgtgtccaaatattaggtgtgacgtttttggaaaaaaaaaagttgaatctaaacatggcccatggacataggccgtgtttagttccatttcaatttttttaagtatacggacacacatttaaaatattaaacgtaaactaataaaaaacaaattattccgatgaatctactcatcctaattaacccgtctttagcctaattaattcccaacggagcctttgttgtatttttattcctgagtaacgctgacacgtgggtcacagtcattagaaaacttttgagataaaaggcggagtagtagtcagtagtactcgagtatctccccattcctcctcgcgtaaaagaaaatctcccgtctcgtcgtctccgttccttgcgccatctcgcggctgaacaggggtcgcgagcagagcaggggatcctggtgagcatccgcatcctctttctgattcatctctctctctcccaccgggactacttttttctggaatttgcttgcgttcgtcaatcctagcttctcttctaaatcttggaagaagctcttctcttcttttcagcgccataaccttaatacaagtaacaatctgtttgttccccaaaaagtttgagggtttaactgaacccctatgtctcaagttggatccgctcctgtaacgtttcccccttaaaaattttttttgggggttcaactaaaccctaggtttattggtatctggtgagtagtatgtacttgcatgatatagatctatatatgtattggtttcttgcaaccagtttgtgaatacgctcttgtatccgcttcttgcaatatcccatctcttcccgtaacaatggtgcattcgccttcttgctcaaatatggggttttgtttcttttgtttttttttatccccaaatgtagttggttgtcgatgcttcttgtggggggcatgccttttaatctgtttggtttgatttaaaatttctccctgaagggtcaatgtgctgtgcttaagtttcttggttcaaaaggtcatggggggcatgccttttagtctgtttggtttgatttaaaatttctccctggagggtcaatatgctgtgcttaagtttcttggttcaaaaggtcatgtttttaactccactgttgtgtacaagttcttcagtttgctactcgatggagagttaatgtgctgagcttaggtttcttggtttataagttcgtctttttaattcacctattgtatacaatacaagaccttcaggttgctactccctggggggtttgaaccaagaaatgccgtacggcacattgacttttcaaggagtagaaagccgaagggttttcatacaatagttgaattaaaaagatgaacttttgaaacaagaaacctaaggacaacacaagttcttcagtttcttggttcaaaatagttccatccttttaattcaactatattgtatacatgcccttcaggttgctattagtactccctgaagggtcaatgtgctgttcttataggtttcttggttcaaaagttcgactttttaattcaactattgtataaaagcccttcagcttgctactctctgagaagtcaatgtgctgtactgcatttcttggataaaaaaaaatcgatagtttgtctttttaactcaaatgttgtatacaagctcttcagtttgctatgtcctggagggccaatttgccgtgcttaaggctcttggttcaaaagtttgtcttttaactcaaatgttgtatacaagcgcttcaagttggtctgatttgaaatttctttttgaaaagaagtgtgatttagaccataggctcccccttctcagctgataggcatgaaaacaacaatgaaaagaattcttgtggaggcctgcttttattccgattgctgtgattcaaatttatccctagagggttaaatggttaatgcgcttgcttagtttgtttggttcaaaagtcctttctttttaactcaagtgctgtatacaagcttttattctggtacgatttaaaatttcttttcagtaagtgtgatttagaccgaaggctaccccttttcagctgatacatgcattaaaacaacaaaagattaacttctcaaggcagtaatcactacaatacatgcaactaataacaatagggtggattcggttggagaatgagccaaactttcttaaaaaggaattgccgtaatacaggttttgcgcttaaaagcttttaatctgctgctgcaagcaattatatctggctggtttgttaatgattacaattgttttgttacctcccttttttatttattcagcaacaaaactttccgtattgatgcaactgtcattgcattattgaattcaacatgttgaatataatgtgtttatcacattgatgtcaattcctcaaaggggtaatctcccctattgtaacattgattaatccccctatttgcagctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgtaggtttctattctaatttattatcttatattcaatttatgggaattcataaccataatcaacatatgtacctggctgatttctagttctgtggtactttattaataggttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagttagtttatccttgatttgtttttttgctgtttgtgctttcctaatattatgtttggtattatgtcttgtttaactatttcttgtttataggactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagtatgtttctccacaagtgcattatccctgtgatttaaaagtgctctgctgtatttgggtttttgtatgctctataccaccgtgtcaaccacaagtgtatcacctcatgactgcattaattttttttcactatctacaggggctgccttttagtacgccagtcatttttccacaacaatcctaataactttgttgacctgggtggtggtgtgatgggctgtcgaggattccattcaagtttccgtggcacacagagtggactttctctgaatatcggtttgtattttgtcctgacatatcgttgtgcaattgcattgtttatcggtttgtattttgtcctgacatatcgttgtgcaattgcattgtttatttgtggtccttacataatcctatatttaagtaatcttcctgaattttcagatgtttcgacaactatgattgttaaacctggtcctgttatcgattttcttcttgccaaccagaaagttgatcaccctgacagaattgattggcaaaaggtgagctttttatttaatatcattgatgtttatgtgttagtaatcatccaaccatattggtacattcttacttggatgttttcttgctcaatacaggccaagcgtgctctcaagaacttgaggataagaaccacccctgtgaattcagaattcaagatcattggtttgagtgacagaaattgcaacgaacagatgtgagagcatattcttccttgctattttattcatctaaagcaattcttaaattaatattttggaaaaggcacccaattgttttgagcttgtattgcagtttttttcctaatcattctgctattatcgattgctttctgattggcatgcttgactaggttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagaggtctgtttaatttttgctattctacatgtttaaaaaagtttactagaattatttattatttcaaactcctgttgtgaatattcttgtattaccagctatgctctcttattccactacaaagatacaccaaagctttgtcaacactgcaaaggtcctcccttgttgagaaatccagacagaagccccaggaaagaatgtcagtccttaatgatgtgagttactattcttgattctaacctgctacaatcatatagaaatggttggaattgtcaacatgactggtaagtgacgattcatgtttaccctaaatgcaaggcacttcgacatagtaattatgattctgatcccatgttgagggcatctggcatttcaattgcccaaaattttactcaagttgaaggaagggtcctgcaacccccaaaggttggtgaggattctctgaattcgtatgttttcacatgctccatgttctattcaacgtaccgcgtctaagtatatattgtatcatgtagctgaaagctggcaatggtgaagatatattcccacgcaatggtcggtggaacttcaacaataaggtcagaatgattttctttatcatatctttattcttggtatggaggaggtcgaggaacattctgatttctttcccttttttcagaaactgattcagacctgttctgtcgataagtgggcagtagttaatttctctgcacgctgtgatgtgcgaaatcttatccgggacctcataagaaatgcatctgcgaaggggattgtatgttttagctttttatcacatattttacgcctgatatttctttgcactgaactttgttaactttgcagcaaatggccgaaccttttgatgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggttcgtcattgtttccactccctaaagtcattcactcccttgcaaaatttacattgttttgtttcaaccaggtccttggaagaggaagtgtcttgctgaattcggtattgtcacacaatgccttgctccacaaagagtcaatgatcagtacctactcaatttgctattgaagataaatgccaaggtatttaacgtaaccttgtcttttcttactgcattatccatttatgtaagcttatggacttgctcttcccctgttactaaccagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtaagagggatatacttttactctcataactccacacactgaactgttgtagctcatgtcatatgcatggatttctcaatttctaagttggggtgcttaattggttattgtatacctttggagttgtttaggtggttagctctcgccaatggcctctcatctctaaatacagagcatcggtgcacactcagtcacctaagctagaaatgatgtcttccttgtttaagccacgaggaactgaagatgatggcctcattcggtaagagatattatttgataaaccattgttgccaatgtatactatgattgctcacaagtatcctttctatagatgcttatctttgcatttgggatttttcagggaatcgctgattgacttctacactagttctggaaaacggaaaccggatcatgttatcgttttcaggtttcgagttcaaaaattgttgtctgtgaatctctctgaattctgtagtaatatcttagatgttcatttactcaaattgttaactgaagctgtcccagcaactgatgtaaatactttctattttttagggatggagttagtgaaagccagtttactcaggtcattaacattgagcttgatcagatcattgaggtgtgtgtttatttcattagccctcccatacctgctactgcacgtccaacttctgtactcaccaagtagtagctatgccctattgctcatttttctttaaatgtaacctattgcccatcgctttcattgttttgcttttaattgatgcagctcatcaagtagtaattatgcctaggactcatctgaaaaatatcacatattgtgcatcactgtttctttggcttttaatcaatgcaggcatgcaaatttctcgatgagaagtggtcaccaaagttcacagtgattgttgctcagaagaatcatcataccaaattttttcagtctggatctccagataatgttccgccaggtaactctttaggcagttttctctgatacctatgttatatcattttactgtgatgaaatcatggcgaggctaaagataaatggtaaacggccttctgtaggtactgttgtggacaaacaagtgtgccatccaaggaattatgacttctacatgtgtgctcatgctggaatgattgtaagctatctctggtttccacctgcagtgcacttattgtgagctcattgctttgtatgctctccgttgcttgtgtttataagatgtttgttgtttcagggaacgacgaggccaacacattatcatgttctgcacgatgagataggtttctcccctgatgatctgcaggagctagtgcactcactctcttatgtgtatgttgaaaactgcactggcatttcatccctgcgatctgttagctagttctgttctgatttgctgcctgtgtccatttcaggtatcagagaagcacaacagccatatcagttggtatgtagcttgtaaattgtaatgccatttctagttctcttcgggtaagatcactgtactgtcctgttggtgcctgaccttgcgcatttgtgtgcagttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagtatctgatctgttcgaggttggggatgaatgaccaaggaaatctttccttgtggttatcatgacatcattgatatcctcaggattactcatcatcagtttactgacgggtaaaatataactggcatggatgaaattatgacgattttcttcccacaac

SEQ ID NO: 885 - DNA, 9106 bp, Oryza sativa
ccttccaaaagagtactcatatacaaaagtaaaaaaaaaaaatttagaacccaccccatctgcgcttccacttcatcctccaattattcaaatttaaaatccttccccattatacctctctttccacaaacacccccaaaactcaaacatggaatctgtaccaaaatcacagcctgaccagggtttgacttaccgccggtaactgcgcagttaccgcgggggtatggtaatataaataccgcggtaacctccttaaattcaaataaatttaaaaaataatttaaatttttgataatttttacacggtttcatacggtttttcatggttatcacgcggtaaccgtgcttaccgccggggcgtggtaactccggcccggcggtgtggaaaaccatgagcctgacacccaaccccccaaatgtggcaattgtaggacagtagcatggttggcaggtgtagggttggccaccattgaagaaggaaacgcaccggcccagctttcgcctcgccctctctcccccctcatcaaaaaatcctttgcgaaaaccaggccagacaacacgcagagatgcagccaccgctcgtactccctccacaccccgcgttgaatgcgccgcgtccaccgtgaaccgcggagacggctcggatgggagggccgcttgggacccacgtgtcggtgggatggtgtttggtaggctcggtccatgggccatggcccatgggcgcgggttccctcgctcgcgcgcgtgcggggcagccttttctggtggaggaagcgaagagaagagagccgagagggcgtggatgcccggggagtttaacggctcgggggacggcgtgaatatccgacggctgggattgcccgcgtggaggcgactcagccgtcggatcgttcgaagcttcggattcctcgccccctccccctccgtcggacttaacgccgtacgcagcggaggatgggtgggtgggctccaccgctccatacggcgaaagtgtcgttgtcacgtctaccgtgagcgcggaactaccctaggcgaaacgaactgctgtcacttacaggtgggcccagaccttcccccggggcccacggtgagcgagtacgtgtcgccgccgggataccatcggcaagctggaaagaaggctgactgttcggcatccacagccacacaggtcgatgacacgtggggccagaaaccctcgtggtccatacgtcagcgatgtcccagcagtaaagcggatggtttcggttgggtagtggaggagaacacgggggtagaggggggagagccccgggggtaaaagcgtcattccaactgggccgtcgtgcgcgcgggggccatctggcccgtccacgtgtcgccgcgcatccccgtgtgctcgcgggggacacgtgtacgttcccgatccacccccgtgccacggtggcgcgggtggcctcgacgaggtcctgcgaagtgccggttttacccttcgtcccctgccgctgcgtcttctcctcctacaagagagagagagagagtgtgtgtggagaggcgaggcgttcgagtttcgagaggagggaggggggacaaggaggaggagcgcaccaccctctcggagaggtcgcctccgttcttgcatcgttttctttggtaaggcgaggagtcccgcttttcattttgggtggagggaaatctagggttcttggcgggggggtttttgcagattggattgttgtgtatgcgggagcggttgggcttgtgttgtttggtgcggttcttggtggtggtggggtttttcggggaggagaggagggcggattccgtggggttttaccgtggaagtttctgttcttttgtgttcttttgcggttttcctctgttcttggtttaaagatcgctgcattttgatgcattctattaaggagtttgatttggggttttctttctttttttcccctgatttcgttcgttcttcgttgcgttgttctcggggctttttcgtcttttgccgtttatggtggtttgttttagatgttttttttgaagatttatccgaaacagtgtttgtgcgattctttttcatttttgcgttctttcttcgtttgatatttctggtccttgttgttttaaacctttattttttttgtttgggagcacctccttttgatgcttgttttggtggatatctgcctgtgtagttttgttagggtttaggggtttttgggaaggtttatgatactgatcttgactgggaaaagaagatttgctgattaagaaaatggctaagtttcttgtacttaaaaatgggtaggttgtgtttgttgtagttttgaaagtctgtaggctggatagactcttctcctatctttttggaagaaaaattaagaaaatagttttctaattttgcttttcttttctttttctggaggaaaaactcttgacccagagcattttcattgtctggtatctgttagcatgggttttagtttcctttccttttctgttttgatttaccttgttaattgttgaatgagttatgtattttgtgtgcaggatagggcagcgctttgacagctttggggagttagtcggtaagtgtactacgctcttaatttggctattaattaatgttttaatctttgtgagttgactaggaattttctatagttgtggtctcactctcagtagttatacatattttttttgcatgtactactagtttctcaggctttcttgttaatgttgcaatcgtctgacaaacgattagtgtctttgaatacattgttaaaaactggagtaccattttaatgtagatggcaaacaagaagcttagttgttttggcaccggttgaccctcgaagtagtagtaacctcaggtcattctcagtatgacagtgtatttaaagtgtactggcaaactcatgtaggtgtgataagagtttggacttgaacggtgacttgaaacgtttgttgtgtgttcttttgtgtgcatatgcaacatggcagactgactgacataacgtttgtgttagcatattactatattatgcttttagttgaatgttttaaaccttgtggtgtcataataattttcttgtattttacgatttcatttgcatgcaaaatatattagtgagacctaggggttttctgtatgattctagttttgaagattgatttaacttgttatattctagtctgagagaagtgtttatttagttggcttttatgctctatttcagagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttcgtctctagcccttgtaacagttctttatttttcttctttgagttccttttgttcatgtctgattgccactactgcttgagttacacaggttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtaattatctatctcaattctttctgctactttcaatgatgccaacattttttacttcaacattttttgctcacataacttccaatgctattaggtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagtatgtttccatatcttttggaagcccctactttgcaaatattctagctatattgtttagaatgtttaacatcatggctgatttgcatttgttcttaacttttcctttttttatgcaggggttgccttttggttcgccaatcctttttccataacaatccttcaaattttgttgacttgggtggtggtgtgatgggctgtaggggattccattcaagcttccgagctacacagagtggactttcactcaatatcggtaaacgattgctattatggccccaatttcatattttgtatgtggtcacatgcacgctgtagctgataatacatgtttgcatgttgctgctttaacttgtgcagatgtgtccacaacgatgattgtgaaacctggtcctgtggtagattttctacttgccaaccagaaggttgatcacccaaacaaaattgactgggcaaaggtattatgtcgtcatttcactgagtaaaacaataatttaagaatgaatgacaagaacaatgtgaaccctttgagatgactgaattgtattgttaacacaaatttgtaggccaagcgtgctctgaagaatttaaggataaaaacaagtccagcaaatactgaatacaagattgttggtttgagtgagagaaactgctatgaacaaatgtgagcttgttcatgtgttgtttttcttatattttatattgttgtgtgcctggatatttgacgtttttgcaattgcaactttggttttttatgtactttgagaaatagctttatttacttagctacacataattatctaggttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgaggtaattgttttccttaatccaacataaatattttccaattaacatcctttgctgattgtggtgaatgttcctatgcttgctagctctgctctcttgtgcctttgcaaaggtataccaaggctttgagtacactacagaggtcttcgcttgttgagaagtccaggcagaaacctgaagaaaggatgtcagttttgtctgatgtgagttgctcctctgtcagcttaagagctgatgtacccctttcctgacagaataatcaaatcatcaatggtgaatttgcaggtgctgaaacgcagcaactatgattcagagcctatgttgaattcttgtggtatttcaattgctcgaggttttacacaagttgctggcagggtgctgcaggcccccaaggtcagtcagaactgtctatgctgcgttttttaattaaccctttgctgtgttctcttatttgtatatggtttagatcaattgtatgtttttctttggcagctaaaagctggaaatggtgaagatctttttgcacgtaatgggcggtggaactttaataataaggttagtgtctcagttctactcccactttactctttagacttccatgttgtgatacatattgtaacttctgttatatcttttttttacagaggctcattaaggctagcagtatcgagaaatgggcagttgttaacttctctgcacggtgtaatattagggatcttgtccgagacatcatcaagtgtggtggcatgaaaggaattgtaggtttttctgttttactcaaaatgttgcatatttcatcaaatgcaattccctcactttagtgttgcatgtttcatcaaatgcgattccctcacttaaaagactggctttgcagaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatggtcagttacactaagattgtgctatgcctattcaaatatgcaacccttctatggcattcacatgttcttctctaatagggccctggaagcggaaatgtcttgctgaatttgggattattacacaatgtgtggcccctactagggtcaatgatcagtatattacaaatgtactgttaaagataaatgcaaaggtttgtggattttcacatccttccttctctcgcattgtaccattttatatctggtctggtcagcactaacatttttgcttgtttattaatcagcttggtggcttgaactccctgcttcaaattgaaacatccccttccattcctcttgtatccaaggtcccgacaataatattgggaatggatgtttcccatggatcacctggacagtctgatataccttcaattgctgcggtaagtaaacttttctaattttctgcactgtaccagaaacgaaaagctttactatacttaatcattagagcaagtttgatagtttagagcttagagagctaactacaagttaataagtataaacccatcttggctaatatttataatagattagctataaggttgccttttttctcctctctctcacttgtatatttaatacatctatcttggagcatgtggagaactagctctttcattagagccaacacataatttttctgtgtctttctccacataagcttatagtgggcttatagtccactattattcttgctcttaccggtccttaattcttaatcgttaacctttttttaggtcgttagttctcgtgaatggcctcttgtatcaaaatacagggcttcagtccgttctcagtcacctaagttagaaatgattgatggactatttaagccacaaggagctcaggaagatgatggcctcattcggtaagcaattttatttggaccgtgatgcaatccttataactttgtggcatgttccattgttcattaaattctcccagtgctaatgatatcttctgccatttgtgctggaaattatttcagggagttattagttgacttctataccagtactggtaaacgtaagcctgatcaagtcattatcttcaggtcagttactctttgaaagcttctcgtaaatgccattaataagcttcagtgaaatacctgaatgcaggattgtaaaagcaaaacttaaattatggacaatgattactttgtgctttgacttaactggttctttgtgtaaccgtttaatttttttcacttatttggtgctttaaatatagggatggggtcagtgagagccagtttacccaggtgctgaacattgagctggatcaaataattgaggtattgttcattataactttctgttctattgtttttagttcttttttattttgtatgcaagactgcaagtatcattactatcatcagctgcacaatcacttttgtatccttaaattgttgcaggcatgcaagtttcttgacgaaaactggtctccaaagtttacactgattgttgcacagaagaatcatcataccaaattttttgtgcctggatctcaaaataacgttcctcctggtaatcccattgttcgatatgttgtgtcaaaacttgcaattgtacatccttaatctaatatctaatgatttgaatgatgtaacttttaggtactgttgtggacaacgcagtctgtcatccaaggaacaatgacttctacatgtgtgcgcacgctggaatgattgtaagtatcgtcttggtgtattttatcggggttggctttaattgggtcacgtataatattccactttcaaggtcgattgtttaggcaagtctttcatattaaaattaagttattgatacatggcacttgtaggctgttgctttgttcaatccttgccctgagttttttatccttcaaaagtgatctagattgatacttaccatgatcccatcaggccaagctttgtactctttgtacataaatgtttgtacgtgtcattgatgaattgaatcagtaactattgacggttgatcaggaatgcattgctacagctggtaacctaactaatgtgcaacttctgatttatgttggatgaattaattcatttatcttgggtgctttatgcaacttgttttaattatgctataaaaccatcttggccagctgtagtattattatgtgaatttctttatagcctaatatcagaaatttctatagtttttttttgtgtgtgttctctgtatgaagtttcactccttttgccagtcccttttttttggtcctacttgaattgatggtggttgtgcctgtgctgtattagggaactacaaggcctacacattatcatatccttcatgatgagataggcttctctgctgacgatcttcaggagttggtccactccctttcctatgtgtaagtttgatatatgccatgattccttttttcacttcttggaaacagacttgttctgacatccaaatgcttgtttgtaccctttcagctaccagaggagcactacagccatatcagtcggtaagtgggcaatacctggtttagtgattgatgtttgcttcgaacttgcatgccagtgtttatttattcatctttatcttgtttccttgcagttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 886 - DNA, 9079 bp, Oryza sativa
agtaaaaaaaaaaaatttagaacccaccccatctgcgcttccacttcatcctccaattattcaaatttaaaatccttccccattatacctctctttccacaaacacccccaaaactcaaacatggaatctgtaccaaaatcacagcctgaccagggtttgacttaccgccggtaactgcgcagttaccgcgggggtatggtaatataaataccgcggtaacctccttaaattcaaataaatttaaaaaataatttaaatttttgataatttttacacggtttcatacggtttttcatggttatcacgcggtaaccgtgcttaccgccggggcgtggtaactccggcccggcggtgtggaaaaccatgagcctgacacccaaccccccaaatgtggcaattgtaggacagtagcatggttggcaggtgtagggttggccaccattgaagaaggaaacgcaccggcccagctttcgcctcgccctctctcccccctcatcaaaaaatcctttgcgaaaaccaggccagacaacacgcagagatgcagccaccgctcgtactccctccacaccccgcgttgaatgcgccgcgtccaccgtgaaccgcggagacggctcggatgggagggccgcttgggacccacgtgtcggtgggatggtgtttggtaggctcggtccatgggccatggcccatgggcgcgggttccctcgctcgcgcgcgtgcggggcagccttttctggtggaggaagcgaagagaagagagccgagagggcgtggatgcccggggagtttaacggctcgggggacggcgtgaatatccgacggctgggattgcccgcgtggaggcgactcagccgtcggatcgttcgaagcttcggattcctcgccccctccccctccgtcggacttaacgccgtacgcagcggaggatgggtgggtgggctccaccgctccatacggcgaaagtgtcgttgtcacgtctaccgtgagcgcggaactaccctaggcgaaacgaactgctgtcacttacaggtgggcccagaccttcccccggggcccacggtgagcgagtacgtgtcgccgccgggataccatcggcaagctggaaagaaggctgactgttcggcatccacagccacacaggtcgatgacacgtggggccagaaaccctcgtggtccatacgtcagcgatgtcccagcagtaaagcggatggtttcggttgggtagtggaggagaacacgggggtagaggggggagagccccgggggtaaaagcgtcattccaactgggccgtcgtgcgcgcgggggccatctggcccgtccacgtgtcgccgcgcatccccgtgtgctcgcgggggacacgtgtacgttcccgatccacccccgtgccacggtggcgcgggtggcctcgacgaggtcctgcgaagtgccggttttacccttcgtcccctgccgctgcgtcttctcctcctacaagagagagagagagagtgtgtgtggagaggcgaggcgttcgagtttcgagaggagggaggggggacaaggaggaggagcgcaccaccctctcggagaggtcgcctccgttcttgcatcgttttctttggtaaggcgaggagtcccgcttttcattttgggtggagggaaatctagggttcttggcgggggggtttttgcagattggattgttgtgtatgcgggagcggttgggcttgtgttgtttggtgcggttcttggtggtggtggggtttttcggggaggagaggagggcggattccgtggggttttaccgtggaagtttctgttcttttgtgttcttttgcggttttcctctgttcttggtttaaagatcgctgcattttgatgcattctattaaggagtttgatttggggttttctttctttttttcccctgatttcgttcgttcttcgttgcgttgttctcggggctttttcgtcttttgccgtttatggtggtttgttttagatgttttttttgaagatttatccgaaacagtgtttgtgcgattctttttcatttttgcgttctttcttcgtttgatatttctggtccttgttgttttaaacctttattttttttgtttgggagcacctccttttgatgcttgttttggtggatatctgcctgtgtagttttgttagggtttaggggtttttgggaaggtttatgatactgatcttgactgggaaaagaagatttgctgattaagaaaatggctaagtttcttgtacttaaaaatgggtaggttgtgtttgttgtagttttgaaagtctgtaggctggatagactcttctcctatctttttggaagaaaaattaagaaaatagttttctaattttgcttttcttttctttttctggaggaaaaactcttgacccagagcattttcattgtctggtatctgttagcatgggttttagtttcctttccttttctgttttgatttaccttgttaattgttgaatgagttatgtattttgtgtgcaggatagggcagcgctttgacagctttggggagttagtcggtaagtgtactacgctcttaatttggctattaattaatgttttaatctttgtgagttgactaggaattttctatagttgtggtctcactctcagtagttatacatattttttttgcatgtactactagtttctcaggctttcttgttaatgttgcaatcgtctgacaaacgattagtgtctttgaatacattgttaaaaactggagtaccattttaatgtagatggcaaacaagaagcttagttgttttggcaccggttgaccctcgaagtagtagtaacctcaggtcattctcagtatgacagtgtatttaaagtgtactggcaaactcatgtaggtgtgataagagtttggacttgaacggtgacttgaaacgtttgttgtgtgttcttttgtgtgcatatgcaacatggcagactgactgacataacgtttgtgttagcatattactatattatgcttttagttgaatgttttaaaccttgtggtgtcataataattttcttgtattttacgatttcatttgcatgcaaaatatattagtgagacctaggggttttctgtatgattctagttttgaagattgatttaacttgttatattctagtctgagagaagtgtttatttagttggcttttatgctctatttcagagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttcgtctctagcccttgtaacagttctttatttttcttctttgagttccttttgttcatgtctgattgccactactgcttgagttacacaggttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtaattatctatctcaattctttctgctactttcaatgatgccaacattttttacttcaacattttttgctcacataacttccaatgctattaggtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagtatgtttccatatcttttggaagcccctactttgcaaatattctagctatattgtttagaatgtttaacatcatggctgatttgcatttgttcttaacttttcctttttttatgcaggggttgccttttggttcgccaatcctttttccataacaatccttcaaattttgttgacttgggtggtggtgtgatgggctgtaggggattccattcaagcttccgagctacacagagtggactttcactcaatatcggtaaacgattgctattatggccccaatttcatattttgtatgtggtcacatgcacgctgtagctgataatacatgtttgcatgttgctgctttaacttgtgcagatgtgtccacaacgatgattgtgaaacctggtcctgtggtagattttctacttgccaaccagaaggttgatcacccaaacaaaattgactgggcaaaggtattatgtcgtcatttcactgagtaaaacaataatttaagaatgaatgacaagaacaatgtgaaccctttgagatgactgaattgtattgttaacacaaatttgtaggccaagcgtgctctgaagaatttaaggataaaaacaagtccagcaaatactgaatacaagattgttggtttgagtgagagaaactgctatgaacaaatgtgagcttgttcatgtgttgtttttcttatattttatattgttgtgtgcctggatatttgacgtttttgcaattgcaactttggttttttatgtactttgagaaatagctttatttacttagctacacataattatctaggttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgaggtaattgttttccttaatccaacataaatattttccaattaacatcctttgctgattgtggtgaatgttcctatgcttgctagctctgctctcttgtgcctttgcaaaggtataccaaggctttgagtacactacagaggtcttcgcttgttgagaagtccaggcagaaacctgaagaaaggatgtcagttttgtctgatgtgagttgctcctctgtcagcttaagagctgatgtacccctttcctgacagaataatcaaatcatcaatggtgaatttgcaggtgctgaaacgcagcaactatgattcagagcctatgttgaattcttgtggtatttcaattgctcgaggttttacacaagttgctggcagggtgctgcaggcccccaaggtcagtcagaactgtctatgctgcgttttttaattaaccctttgctgtgttctcttatttgtatatggtttagatcaattgtatgtttttctttggcagctaaaagctggaaatggtgaagatctttttgcacgtaatgggcggtggaactttaataataaggttagtgtctcagttctactcccactttactctttagacttccatgttgtgatacatattgtaacttctgttatatcttttttttacagaggctcattaaggctagcagtatcgagaaatgggcagttgttaacttctctgcacggtgtaatattagggatcttgtccgagacatcatcaagtgtggtggcatgaaaggaattgtaggtttttctgttttactcaaaatgttgcatatttcatcaaatgcaattccctcactttagtgttgcatgtttcatcaaatgcgattccctcacttaaaagactggctttgcagaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatggtcagttacactaagattgtgctatgcctattcaaatatgcaacccttctatggcattcacatgttcttctctaatagggccctggaagcggaaatgtcttgctgaatttgggattattacacaatgtgtggcccctactagggtcaatgatcagtatattacaaatgtactgttaaagataaatgcaaaggtttgtggattttcacatccttccttctctcgcattgtaccattttatatctggtctggtcagcactaacatttttgcttgtttattaatcagcttggtggcttgaactccctgcttcaaattgaaacatccccttccattcctcttgtatccaaggtcccgacaataatattgggaatggatgtttcccatggatcacctggacagtctgatataccttcaattgctgcggtaagtaaacttttctaattttctgcactgtaccagaaacgaaaagctttactatacttaatcattagagcaagtttgatagtttagagcttagagagctaactacaagttaataagtataaacccatcttggctaatatttataatagattagctataaggttgccttttttctcctctctctcacttgtatatttaatacatctatcttggagcatgtggagaactagctctttcattagagccaacacataatttttctgtgtctttctccacataagcttatagtgggcttatagtccactattattcttgctcttaccggtccttaattcttaatcgttaacctttttttaggtcgttagttctcgtgaatggcctcttgtatcaaaatacagggcttcagtccgttctcagtcacctaagttagaaatgattgatggactatttaagccacaaggagctcaggaagatgatggcctcattcggtaagcaattttatttggaccgtgatgcaatccttataactttgtggcatgttccattgttcattaaattctcccagtgctaatgatatcttctgccatttgtgctggaaattatttcagggagttattagttgacttctataccagtactggtaaacgtaagcctgatcaagtcattatcttcaggtcagttactctttgaaagcttctcgtaaatgccattaataagcttcagtgaaatacctgaatgcaggattgtaaaagcaaaacttaaattatggacaatgattactttgtgctttgacttaactggttctttgtgtaaccgtttaatttttttcacttatttggtgctttaaatatagggatggggtcagtgagagccagtttacccaggtgctgaacattgagctggatcaaataattgaggtattgttcattataactttctgttctattgtttttagttcttttttattttgtatgcaagactgcaagtatcattactatcatcagctgcacaatcacttttgtatccttaaattgttgcaggcatgcaagtttcttgacgaaaactggtctccaaagtttacactgattgttgcacagaagaatcatcataccaaattttttgtgcctggatctcaaaataacgttcctcctggtaatcccattgttcgatatgttgtgtcaaaacttgcaattgtacatccttaatctaatatctaatgatttgaatgatgtaacttttaggtactgttgtggacaacgcagtctgtcatccaaggaacaatgacttctacatgtgtgcgcacgctggaatgattgtaagtatcgtcttggtgtattttatcggggttggctttaattgggtcacgtataatattccactttcaaggtcgattgtttaggcaagtctttcatattaaaattaagttattgatacatggcacttgtaggctgttgctttgttcaatccttgccctgagttttttatccttcaaaagtgatctagattgatacttaccatgatcccatcaggccaagctttgtactctttgtacataaatgtttgtacgtgtcattgatgaattgaatcagtaactattgacggttgatcaggaatgcattgctacagctggtaacctaactaatgtgcaacttctgatttatgttggatgaattaattcatttatcttgggtgctttatgcaacttgttttaattatgctataaaaccatcttggccagctgtagtattattatgtgaatttctttatagcctaatatcagaaatttctatagtttttttttgtgtgtgttctctgtatgaagtttcactccttttgccagtcccttttttttggtcctacttgaattgatggtggttgtgcctgtgctgtattagggaactacaaggcctacacattatcatatccttcatgatgagataggcttctctgctgacgatcttcaggagttggtccactccctttcctatgtgtaagtttgatatatgccatgattccttttttcacttcttggaaacagacttgttctgacatccaaatgcttgtttgtaccctttcagctaccagaggagcactacagccatatcagtcggtaagtgggcaatacctggtttagtgattgatgtttgcttcgaacttgcatgccagtgtttatttattcatctttatcttgtttccttgcagttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 887 - DNA, 9074 bp, Oryza sativa
aaaaaaaaaatttagaacccaccccatctgcgcttccacttcatcctccaattattcaaatttaaaatccttccccattatacctctctttccacaaacacccccaaaactcaaacatggaatctgtaccaaaatcacagcctgaccagggtttgacttaccgccggtaactgcgcagttaccgcgggggtatggtaatataaataccgcggtaacctccttaaattcaaataaatttaaaaaataatttaaatttttgataatttttacacggtttcatacggtttttcatggttatcacgcggtaaccgtgcttaccgccggggcgtggtaactccggcccggcggtgtggaaaaccatgagcctgacacccaaccccccaaatgtggcaattgtaggacagtagcatggttggcaggtgtagggttggccaccattgaagaaggaaacgcaccggcccagctttcgcctcgccctctctcccccctcatcaaaaaatcctttgcgaaaaccaggccagacaacacgcagagatgcagccaccgctcgtactccctccacaccccgcgttgaatgcgccgcgtccaccgtgaaccgcggagacggctcggatgggagggccgcttgggacccacgtgtcggtgggatggtgtttggtaggctcggtccatgggccatggcccatgggcgcgggttccctcgctcgcgcgcgtgcggggcagccttttctggtggaggaagcgaagagaagagagccgagagggcgtggatgcccggggagtttaacggctcgggggacggcgtgaatatccgacggctgggattgcccgcgtggaggcgactcagccgtcggatcgttcgaagcttcggattcctcgccccctccccctccgtcggacttaacgccgtacgcagcggaggatgggtgggtgggctccaccgctccatacggcgaaagtgtcgttgtcacgtctaccgtgagcgcggaactaccctaggcgaaacgaactgctgtcacttacaggtgggcccagaccttcccccggggcccacggtgagcgagtacgtgtcgccgccgggataccatcggcaagctggaaagaaggctgactgttcggcatccacagccacacaggtcgatgacacgtggggccagaaaccctcgtggtccatacgtcagcgatgtcccagcagtaaagcggatggtttcggttgggtagtggaggagaacacgggggtagaggggggagagccccgggggtaaaagcgtcattccaactgggccgtcgtgcgcgcgggggccatctggcccgtccacgtgtcgccgcgcatccccgtgtgctcgcgggggacacgtgtacgttcccgatccacccccgtgccacggtggcgcgggtggcctcgacgaggtcctgcgaagtgccggttttacccttcgtcccctgccgctgcgtcttctcctcctacaagagagagagagagagtgtgtgtggagaggcgaggcgttcgagtttcgagaggagggaggggggacaaggaggaggagcgcaccaccctctcggagaggtcgcctccgttcttgcatcgttttctttggtaaggcgaggagtcccgcttttcattttgggtggagggaaatctagggttcttggcgggggggtttttgcagattggattgttgtgtatgcgggagcggttgggcttgtgttgtttggtgcggttcttggtggtggtggggtttttcggggaggagaggagggcggattccgtggggttttaccgtggaagtttctgttcttttgtgttcttttgcggttttcctctgttcttggtttaaagatcgctgcattttgatgcattctattaaggagtttgatttggggttttctttctttttttcccctgatttcgttcgttcttcgttgcgttgttctcggggctttttcgtcttttgccgtttatggtggtttgttttagatgttttttttgaagatttatccgaaacagtgtttgtgcgattctttttcatttttgcgttctttcttcgtttgatatttctggtccttgttgttttaaacctttattttttttgtttgggagcacctccttttgatgcttgttttggtggatatctgcctgtgtagttttgttagggtttaggggtttttgggaaggtttatgatactgatcttgactgggaaaagaagatttgctgattaagaaaatggctaagtttcttgtacttaaaaatgggtaggttgtgtttgttgtagttttgaaagtctgtaggctggatagactcttctcctatctttttggaagaaaaattaagaaaatagttttctaattttgcttttcttttctttttctggaggaaaaactcttgacccagagcattttcattgtctggtatctgttagcatgggttttagtttcctttccttttctgttttgatttaccttgttaattgttgaatgagttatgtattttgtgtgcaggatagggcagcgctttgacagctttggggagttagtcggtaagtgtactacgctcttaatttggctattaattaatgttttaatctttgtgagttgactaggaattttctatagttgtggtctcactctcagtagttatacatattttttttgcatgtactactagtttctcaggctttcttgttaatgttgcaatcgtctgacaaacgattagtgtctttgaatacattgttaaaaactggagtaccattttaatgtagatggcaaacaagaagcttagttgttttggcaccggttgaccctcgaagtagtagtaacctcaggtcattctcagtatgacagtgtatttaaagtgtactggcaaactcatgtaggtgtgataagagtttggacttgaacggtgacttgaaacgtttgttgtgtgttcttttgtgtgcatatgcaacatggcagactgactgacataacgtttgtgttagcatattactatattatgcttttagttgaatgttttaaaccttgtggtgtcataataattttcttgtattttacgatttcatttgcatgcaaaatatattagtgagacctaggggttttctgtatgattctagttttgaagattgatttaacttgttatattctagtctgagagaagtgtttatttagttggcttttatgctctatttcagagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttcgtctctagcccttgtaacagttctttatttttcttctttgagttccttttgttcatgtctgattgccactactgcttgagttacacaggttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtaattatctatctcaattctttctgctactttcaatgatgccaacattttttacttcaacattttttgctcacataacttccaatgctattaggtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagtatgtttccatatcttttggaagcccctactttgcaaatattctagctatattgtttagaatgtttaacatcatggctgatttgcatttgttcttaacttttcctttttttatgcaggggttgccttttggttcgccaatcctttttccataacaatccttcaaattttgttgacttgggtggtggtgtgatgggctgtaggggattccattcaagcttccgagctacacagagtggactttcactcaatatcggtaaacgattgctattatggccccaatttcatattttgtatgtggtcacatgcacgctgtagctgataatacatgtttgcatgttgctgctttaacttgtgcagatgtgtccacaacgatgattgtgaaacctggtcctgtggtagattttctacttgccaaccagaaggttgatcacccaaacaaaattgactgggcaaaggtattatgtcgtcatttcactgagtaaaacaataatttaagaatgaatgacaagaacaatgtgaaccctttgagatgactgaattgtattgttaacacaaatttgtaggccaagcgtgctctgaagaatttaaggataaaaacaagtccagcaaatactgaatacaagattgttggtttgagtgagagaaactgctatgaacaaatgtgagcttgttcatgtgttgtttttcttatattttatattgttgtgtgcctggatatttgacgtttttgcaattgcaactttggttttttatgtactttgagaaatagctttatttacttagctacacataattatctaggttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgaggtaattgttttccttaatccaacataaatattttccaattaacatcctttgctgattgtggtgaatgttcctatgcttgctagctctgctctcttgtgcctttgcaaaggtataccaaggctttgagtacactacagaggtcttcgcttgttgagaagtccaggcagaaacctgaagaaaggatgtcagttttgtctgatgtgagttgctcctctgtcagcttaagagctgatgtacccctttcctgacagaataatcaaatcatcaatggtgaatttgcaggtgctgaaacgcagcaactatgattcagagcctatgttgaattcttgtggtatttcaattgctcgaggttttacacaagttgctggcagggtgctgcaggcccccaaggtcagtcagaactgtctatgctgcgttttttaattaaccctttgctgtgttctcttatttgtatatggtttagatcaattgtatgtttttctttggcagctaaaagctggaaatggtgaagatctttttgcacgtaatgggcggtggaactttaataataaggttagtgtctcagttctactcccactttactctttagacttccatgttgtgatacatattgtaacttctgttatatcttttttttacagaggctcattaaggctagcagtatcgagaaatgggcagttgttaacttctctgcacggtgtaatattagggatcttgtccgagacatcatcaagtgtggtggcatgaaaggaattgtaggtttttctgttttactcaaaatgttgcatatttcatcaaatgcaattccctcactttagtgttgcatgtttcatcaaatgcgattccctcacttaaaagactggctttgcagaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatggtcagttacactaagattgtgctatgcctattcaaatatgcaacccttctatggcattcacatgttcttctctaatagggccctggaagcggaaatgtcttgctgaatttgggattattacacaatgtgtggcccctactagggtcaatgatcagtatattacaaatgtactgttaaagataaatgcaaaggtttgtggattttcacatccttccttctctcgcattgtaccattttatatctggtctggtcagcactaacatttttgcttgtttattaatcagcttggtggcttgaactccctgcttcaaattgaaacatccccttccattcctcttgtatccaaggtcccgacaataatattgggaatggatgtttcccatggatcacctggacagtctgatataccttcaattgctgcggtaagtaaacttttctaattttctgcactgtaccagaaacgaaaagctttactatacttaatcattagagcaagtttgatagtttagagcttagagagctaactacaagttaataagtataaacccatcttggctaatatttataatagattagctataaggttgccttttttctcctctctctcacttgtatatttaatacatctatcttggagcatgtggagaactagctctttcattagagccaacacataatttttctgtgtctttctccacataagcttatagtgggcttatagtccactattattcttgctcttaccggtccttaattcttaatcgttaacctttttttaggtcgttagttctcgtgaatggcctcttgtatcaaaatacagggcttcagtccgttctcagtcacctaagttagaaatgattgatggactatttaagccacaaggagctcaggaagatgatggcctcattcggtaagcaattttatttggaccgtgatgcaatccttataactttgtggcatgttccattgttcattaaattctcccagtgctaatgatatcttctgccatttgtgctggaaattatttcagggagttattagttgacttctataccagtactggtaaacgtaagcctgatcaagtcattatcttcaggtcagttactctttgaaagcttctcgtaaatgccattaataagcttcagtgaaatacctgaatgcaggattgtaaaagcaaaacttaaattatggacaatgattactttgtgctttgacttaactggttctttgtgtaaccgtttaatttttttcacttatttggtgctttaaatatagggatggggtcagtgagagccagtttacccaggtgctgaacattgagctggatcaaataattgaggtattgttcattataactttctgttctattgtttttagttcttttttattttgtatgcaagactgcaagtatcattactatcatcagctgcacaatcacttttgtatccttaaattgttgcaggcatgcaagtttcttgacgaaaactggtctccaaagtttacactgattgttgcacagaagaatcatcataccaaattttttgtgcctggatctcaaaataacgttcctcctggtaatcccattgttcgatatgttgtgtcaaaacttgcaattgtacatccttaatctaatatctaatgatttgaatgatgtaacttttaggtactgttgtggacaacgcagtctgtcatccaaggaacaatgacttctacatgtgtgcgcacgctggaatgattgtaagtatcgtcttggtgtattttatcggggttggctttaattgggtcacgtataatattccactttcaaggtcgattgtttaggcaagtctttcatattaaaattaagttattgatacatggcacttgtaggctgttgctttgttcaatccttgccctgagttttttatccttcaaaagtgatctagattgatacttaccatgatcccatcaggccaagctttgtactctttgtacataaatgtttgtacgtgtcattgatgaattgaatcagtaactattgacggttgatcaggaatgcattgctacagctggtaacctaactaatgtgcaacttctgatttatgttggatgaattaattcatttatcttgggtgctttatgcaacttgttttaattatgctataaaaccatcttggccagctgtagtattattatgtgaatttctttatagcctaatatcagaaatttctatagtttttttttgtgtgtgttctctgtatgaagtttcactccttttgccagtcccttttttttggtcctacttgaattgatggtggttgtgcctgtgctgtattagggaactacaaggcctacacattatcatatccttcatgatgagataggcttctctgctgacgatcttcaggagttggtccactccctttcctatgtgtaagtttgatatatgccatgattccttttttcacttcttggaaacagacttgttctgacatccaaatgcttgtttgtaccctttcagctaccagaggagcactacagccatatcagtcggtaagtgggcaatacctggtttagtgattgatgtttgcttcgaacttgcatgccagtgtttatttattcatctttatcttgtttccttgcagttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 888 - DNA, 9088 bp, Oryza sativa
atatacaaaagtaaaaaaaaaaaatttagaacccaccccatctgcgcttccacttcatcctccaattattcaaatttaaaatccttccccattatacctctctttccacaaacacccccaaaactcaaacatggaatctgtaccaaaatcacagcctgaccagggtttgacttaccgccggtaactgcgcagttaccgcgggggtatggtaatataaataccgcggtaacctccttaaattcaaataaatttaaaaaataatttaaatttttgataatttttacacggtttcatacggtttttcatggttatcacgcggtaaccgtgcttaccgccggggcgtggtaactccggcccggcggtgtggaaaaccatgagcctgacacccaaccccccaaatgtggcaattgtaggacagtagcatggttggcaggtgtagggttggccaccattgaagaaggaaacgcaccggcccagctttcgcctcgccctctctcccccctcatcaaaaaatcctttgcgaaaaccaggccagacaacacgcagagatgcagccaccgctcgtactccctccacaccccgcgttgaatgcgccgcgtccaccgtgaaccgcggagacggctcggatgggagggccgcttgggacccacgtgtcggtgggatggtgtttggtaggctcggtccatgggccatggcccatgggcgcgggttccctcgctcgcgcgcgtgcggggcagccttttctggtggaggaagcgaagagaagagagccgagagggcgtggatgcccggggagtttaacggctcgggggacggcgtgaatatccgacggctgggattgcccgcgtggaggcgactcagccgtcggatcgttcgaagcttcggattcctcgccccctccccctccgtcggacttaacgccgtacgcagcggaggatgggtgggtgggctccaccgctccatacggcgaaagtgtcgttgtcacgtctaccgtgagcgcggaactaccctaggcgaaacgaactgctgtcacttacaggtgggcccagaccttcccccggggcccacggtgagcgagtacgtgtcgccgccgggataccatcggcaagctggaaagaaggctgactgttcggcatccacagccacacaggtcgatgacacgtggggccagaaaccctcgtggtccatacgtcagcgatgtcccagcagtaaagcggatggtttcggttgggtagtggaggagaacacgggggtagaggggggagagccccgggggtaaaagcgtcattccaactgggccgtcgtgcgcgcgggggccatctggcccgtccacgtgtcgccgcgcatccccgtgtgctcgcgggggacacgtgtacgttcccgatccacccccgtgccacggtggcgcgggtggcctcgacgaggtcctgcgaagtgccggttttacccttcgtcccctgccgctgcgtcttctcctcctacaagagagagagagagagtgtgtgtggagaggcgaggcgttcgagtttcgagaggagggaggggggacaaggaggaggagcgcaccaccctctcggagaggtcgcctccgttcttgcatcgttttctttggtaaggcgaggagtcccgcttttcattttgggtggagggaaatctagggttcttggcgggggggtttttgcagattggattgttgtgtatgcgggagcggttgggcttgtgttgtttggtgcggttcttggtggtggtggggtttttcggggaggagaggagggcggattccgtggggttttaccgtggaagtttctgttcttttgtgttcttttgcggttttcctctgttcttggtttaaagatcgctgcattttgatgcattctattaaggagtttgatttggggttttctttctttttttcccctgatttcgttcgttcttcgttgcgttgttctcggggctttttcgtcttttgccgtttatggtggtttgttttagatgttttttttgaagatttatccgaaacagtgtttgtgcgattctttttcatttttgcgttctttcttcgtttgatatttctggtccttgttgttttaaacctttattttttttgtttgggagcacctccttttgatgcttgttttggtggatatctgcctgtgtagttttgttagggtttaggggtttttgggaaggtttatgatactgatcttgactgggaaaagaagatttgctgattaagaaaatggctaagtttcttgtacttaaaaatgggtaggttgtgtttgttgtagttttgaaagtctgtaggctggatagactcttctcctatctttttggaagaaaaattaagaaaatagttttctaattttgcttttcttttctttttctggaggaaaaactcttgacccagagcattttcattgtctggtatctgttagcatgggttttagtttcctttccttttctgttttgatttaccttgttaattgttgaatgagttatgtattttgtgtgcaggatagggcagcgctttgacagctttggggagttagtcggtaagtgtactacgctcttaatttggctattaattaatgttttaatctttgtgagttgactaggaattttctatagttgtggtctcactctcagtagttatacatattttttttgcatgtactactagtttctcaggctttcttgttaatgttgcaatcgtctgacaaacgattagtgtctttgaatacattgttaaaaactggagtaccattttaatgtagatggcaaacaagaagcttagttgttttggcaccggttgaccctcgaagtagtagtaacctcaggtcattctcagtatgacagtgtatttaaagtgtactggcaaactcatgtaggtgtgataagagtttggacttgaacggtgacttgaaacgtttgttgtgtgttcttttgtgtgcatatgcaacatggcagactgactgacataacgtttgtgttagcatattactatattatgcttttagttgaatgttttaaaccttgtggtgtcataataattttcttgtattttacgatttcatttgcatgcaaaatatattagtgagacctaggggttttctgtatgattctagttttgaagattgatttaacttgttatattctagtctgagagaagtgtttatttagttggcttttatgctctatttcagagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttcgtctctagcccttgtaacagttctttatttttcttctttgagttccttttgttcatgtctgattgccactactgcttgagttacacaggttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtaattatctatctcaattctttctgctactttcaatgatgccaacattttttacttcaacattttttgctcacataacttccaatgctattaggtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagtatgtttccatatcttttggaagcccctactttgcaaatattctagctatattgtttagaatgtttaacatcatggctgatttgcatttgttcttaacttttcctttttttatgcaggggttgccttttggttcgccaatcctttttccataacaatccttcaaattttgttgacttgggtggtggtgtgatgggctgtaggggattccattcaagcttccgagctacacagagtggactttcactcaatatcggtaaacgattgctattatggccccaatttcatattttgtatgtggtcacatgcacgctgtagctgataatacatgtttgcatgttgctgctttaacttgtgcagatgtgtccacaacgatgattgtgaaacctggtcctgtggtagattttctacttgccaaccagaaggttgatcacccaaacaaaattgactgggcaaaggtattatgtcgtcatttcactgagtaaaacaataatttaagaatgaatgacaagaacaatgtgaaccctttgagatgactgaattgtattgttaacacaaatttgtaggccaagcgtgctctgaagaatttaaggataaaaacaagtccagcaaatactgaatacaagattgttggtttgagtgagagaaactgctatgaacaaatgtgagcttgttcatgtgttgtttttcttatattttatattgttgtgtgcctggatatttgacgtttttgcaattgcaactttggttttttatgtactttgagaaatagctttatttacttagctacacataattatctaggttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgaggtaattgttttccttaatccaacataaatattttccaattaacatcctttgctgattgtggtgaatgttcctatgcttgctagctctgctctcttgtgcctttgcaaaggtataccaaggctttgagtacactacagaggtcttcgcttgttgagaagtccaggcagaaacctgaagaaaggatgtcagttttgtctgatgtgagttgctcctctgtcagcttaagagctgatgtacccctttcctgacagaataatcaaatcatcaatggtgaatttgcaggtgctgaaacgcagcaactatgattcagagcctatgttgaattcttgtggtatttcaattgctcgaggttttacacaagttgctggcagggtgctgcaggcccccaaggtcagtcagaactgtctatgctgcgttttttaattaaccctttgctgtgttctcttatttgtatatggtttagatcaattgtatgtttttctttggcagctaaaagctggaaatggtgaagatctttttgcacgtaatgggcggtggaactttaataataaggttagtgtctcagttctactcccactttactctttagacttccatgttgtgatacatattgtaacttctgttatatcttttttttacagaggctcattaaggctagcagtatcgagaaatgggcagttgttaacttctctgcacggtgtaatattagggatcttgtccgagacatcatcaagtgtggtggcatgaaaggaattgtaggtttttctgttttactcaaaatgttgcatatttcatcaaatgcaattccctcactttagtgttgcatgtttcatcaaatgcgattccctcacttaaaagactggctttgcagaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatggtcagttacactaagattgtgctatgcctattcaaatatgcaacccttctatggcattcacatgttcttctctaatagggccctggaagcggaaatgtcttgctgaatttgggattattacacaatgtgtggcccctactagggtcaatgatcagtatattacaaatgtactgttaaagataaatgcaaaggtttgtggattttcacatccttccttctctcgcattgtaccattttatatctggtctggtcagcactaacatttttgcttgtttattaatcagcttggtggcttgaactccctgcttcaaattgaaacatccccttccattcctcttgtatccaaggtcccgacaataatattgggaatggatgtttcccatggatcacctggacagtctgatataccttcaattgctgcggtaagtaaacttttctaattttctgcactgtaccagaaacgaaaagctttactatacttaatcattagagcaagtttgatagtttagagcttagagagctaactacaagttaataagtataaacccatcttggctaatatttataatagattagctataaggttgccttttttctcctctctctcacttgtatatttaatacatctatcttggagcatgtggagaactagctctttcattagagccaacacataatttttctgtgtctttctccacataagcttatagtgggcttatagtccactattattcttgctcttaccggtccttaattcttaatcgttaacctttttttaggtcgttagttctcgtgaatggcctcttgtatcaaaatacagggcttcagtccgttctcagtcacctaagttagaaatgattgatggactatttaagccacaaggagctcaggaagatgatggcctcattcggtaagcaattttatttggaccgtgatgcaatccttataactttgtggcatgttccattgttcattaaattctcccagtgctaatgatatcttctgccatttgtgctggaaattatttcagggagttattagttgacttctataccagtactggtaaacgtaagcctgatcaagtcattatcttcaggtcagttactctttgaaagcttctcgtaaatgccattaataagcttcagtgaaatacctgaatgcaggattgtaaaagcaaaacttaaattatggacaatgattactttgtgctttgacttaactggttctttgtgtaaccgtttaatttttttcacttatttggtgctttaaatatagggatggggtcagtgagagccagtttacccaggtgctgaacattgagctggatcaaataattgaggtattgttcattataactttctgttctattgtttttagttcttttttattttgtatgcaagactgcaagtatcattactatcatcagctgcacaatcacttttgtatccttaaattgttgcaggcatgcaagtttcttgacgaaaactggtctccaaagtttacactgattgttgcacagaagaatcatcataccaaattttttgtgcctggatctcaaaataacgttcctcctggtaatcccattgttcgatatgttgtgtcaaaacttgcaattgtacatccttaatctaatatctaatgatttgaatgatgtaacttttaggtactgttgtggacaacgcagtctgtcatccaaggaacaatgacttctacatgtgtgcgcacgctggaatgattgtaagtatcgtcttggtgtattttatcggggttggctttaattgggtcacgtataatattccactttcaaggtcgattgtttaggcaagtctttcatattaaaattaagttattgatacatggcacttgtaggctgttgctttgttcaatccttgccctgagttttttatccttcaaaagtgatctagattgatacttaccatgatcccatcaggccaagctttgtactctttgtacataaatgtttgtacgtgtcattgatgaattgaatcagtaactattgacggttgatcaggaatgcattgctacagctggtaacctaactaatgtgcaacttctgatttatgttggatgaattaattcatttatcttgggtgctttatgcaacttgttttaattatgctataaaaccatcttggccagctgtagtattattatgtgaatttctttatagcctaatatcagaaatttctatagtttttttttgtgtgtgttctctgtatgaagtttcactccttttgccagtcccttttttttggtcctacttgaattgatggtggttgtgcctgtgctgtattagggaactacaaggcctacacattatcatatccttcatgatgagataggcttctctgctgacgatcttcaggagttggtccactccctttcctatgtgtaagtttgatatatgccatgattccttttttcacttcttggaaacagacttgttctgacatccaaatgcttgtttgtaccctttcagctaccagaggagcactacagccatatcagtcggtaagtgggcaatacctggtttagtgattgatgtttgcttcgaacttgcatgccagtgtttatttattcatctttatcttgtttccttgcagttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 889 - DNA, 9133 bp, Oryza sativa
acaaagttaatatttacatagatttttcatgtatattgtaatgcaaaaattatccttgtcagggaccatgaaagaaatactagtacttttctgactggaatagggttttatcggatatcggtggtacgcctttcatcaacgattgcatatctggacttattgcatagtacaatactttttttttggggtcaaatatatgcattaccctaaaaagatcctacaatatccaaatgtacatcctacagtatgatttgttttttcttttctttttttggttgaccacaagtttgcctccacagaagtgtgtattaaggtttataaactttttaaatggaagtgtactgaagcaattcatgtagttaagtaagttttacttcaacctgagcttaatcctgttcatcagtgatttcacacctttactgatgcagattccccatgaaagtacgaaatggaagcagtgaaggtgaaaccgttgaaattactgtccaggaatattttaagtccaagcaggtggatttaacaatgccttatttgccatgtcttgatgtgggaaaaccaaaacgcccaaattatgttccaattgaggttgctggcaccaatcctgtttgcctattcatttcatactatggctggtaagtctactttctgaatgtgcttgatgtccaattttttatgtgtctttcgggctgcagctgtgccatatggtatcacttcaaagatatacaaaggcgctttcttctcaacaaagagcaaccttggttgaaaaatcacgtcagaaacctcaagagcgcatgcgagttgttactgatgtgggtttactgaattctgtcaataccactgtatgttccagttttaacctttgagttactaacatacacttttcaggctgtaaaaaacaatagatatgatgatgatccaatcttatcttcttgtggaattaaaattgagaaacaactcactcgtgtcgatggtcgtgttctgtctgcaccaacggttaggcctcatccatttatccttttttctcctttcatatgcgactcatgttctctgattattttgatttgttaatccagctagtcgtggggaatagtgaagattgcattccaaacagaggcagatggaactacaataacaaggtggttaggctacttgtaatggtacacattgctatcaaaaacattccgtcctgaacttttttcatttggccactgttacagaggctatttgagcctgtcaagattgagcgttgggcaattgttaatttctctgctcggtgtgacatgagccggatctcaagagacctgataaactgtggacgaactaaaggcattgtaagtttttgtgttcctttttttatattgcagtaaatcctatgtagcctaacttgtaatgatgtgctttgacaatgtaatttatccctttcttcttgcatagattattgaacgccctttcaccttggtagatgaggatagccaatctaggagatgtactcctgttgtaagggttgaaagcatgtttgaaaaagtgaaagcaaaccttcctggtcctcctgaatttttgctgtgtgttttaccagaaaggaaaaattgtgatctctatggtaatagcctaataggttacacattacttatttctgccctcatgaattcttcaatattcgtaccatctcatcaatctgttttgtagggccatggaagaagaaaaaccttcatgagatgggtattattactcaatgcattgttcctagtgttaagatgaatgatcagtactataccaatgttcttctgaaaatcaatgctaaggtacaggcacttcatctctatttgattgtgccttaaactttgatccaacaatcttgttcacatgaattactttcttatctaaaatttttattcctgtttattagcttggtggaatgaactccaagctttcattggagcatcgacatatgattcccattgtcaatcaaacacccacattaattttgggaatggatgtttcacatggttcgccaggtcgagctgatgtaccatcaattgctgcggtatgtcttattccctctgcattattttgcatgcaccaaatatctgtgttgtgtttccatccttgagtggtcctacattcagttgcctagtatagatgcagggctgtactagaaaattaggaggcatatgtgccaaaattgtcatgtgctaaaattttgagctattgcatggtaactacagcttaattatgccacagaatccagtgaacattctccaattaaagccaatagttacaattcataattcatgaggacaccaggaaaaaaaattatgttacaaacaggacctttgtttgtaagaaaacatcaaatatagtctgaaaaaatgctgctattacacaagatgcatcactgttgagtataatgaaaccatgaaatgccttaggagttttaaaaaaataagatgatatttgagatcaatgtaaaattactgatgctcgacatagaactcctgccaagttaatctgatcttagttcacaagttatagtaactgagaaacacttcataactatacttcaaatcctccataatatagaactagaggtggatgttccattgatacttttcctgcatgttgtgtgggtaagtggaatgataaaatggtaaacatgatgtgaaaggtggatggtaacttcgtagctagaaagtttgattttgtgtgatctgtacaaatttgcatcttacatcattcatccaaacagtgaaaataattgagatgatgtttccttccttagggtagttggggatttgtcccatcacctactgtctttttattcagttaaagaacttgttgcctgtgtgccatatggtttaggccggggatgtaatacatttccataattccattatctaagtacatacaagaagaaaaatgatttgcaccttagatcaatcatccaaatgctaaaagttattgagaagatgccgctttttcattgacatgaggcaacacttcatctgtcccaaaatataagcatttttagcattgtaacaagtcaaatatttttaactttgactattaatagcaaaaaaaattaaaaggatcaatcatgtaaaattgatgttactagatttttattaaacaaactatcataatatgcaactctttttatttaaaacatctcacttttatagatattgttggtcaaaatagcatctcggagactatgtcagagtccaaaaatgattatattttgggactgaggaagtaggatatggggccctcaatcttgttagggccctttgtggcagcagagcttgcacatcgctcattcagctagtggtgatgacatcatattttgctacaggttgttgggtccagatgttggccgctgatatcacgctacagagcatctgtccggacccagtctccaaaggtagagatgattgattctctttttaagccactggacgatggaaaagatgatggcataataaggtgctctaaactaatcgtcctactctgtattgtttctgcttaataccttatgttattttaggcgtactgttgtaaaaagttattcactcaggaagtagtctactagtctgagcctaagatgcctatttacaaaaatgttctttttttctactgtaactttgctttgcagggaacttctactggacttctacaagaccagtcaacaaagaaagccgaagcagataatcattttcaggtctttatcagtttattgttatctacttattactttcagttttgcatatgttggatattcgtggcacgcttttcaaattgctaaacggtgcatttcatgtgaaaactttctatatggaagtttctctaaaataccagataaatatatttttcaagtttgtaataattaaaactcaattaatcatacgttaatacctcctcgttttacggaaaacacttaatcttcatctacatgagtttcaaacaccacaaatctgatctatgatctatatgcacttcaaatttttttatcacacacttgatgcttatgttgatgcctttaaggaccgtttaattctcaaagaattttccttggatggatttttcattctacaaaagaaaatgttggcagttgaaagttagtttctataagcaaatttactttgctagtttgtgaaaagaaagagtgatggctaaagggagatgcatgctcaacaaggctttttgccaattctagattatacaatatatcaagatgatgggtcgaaccagcatttatcacagatttttattccacccttacatagtttattatggaaattgtacgttgtcaacgattgaaggaaatgctcatcatagctgttaacaatcagctagttaatgttatatggtatgtgttgttatagccacgtttacttgtttaatattgtcactctaaatcttctgtaaactcttaagatatattttatcaagtactcccttcgtcccaaaatataacttttaacaatgcaaaatttatcccaaaatataacatctaacattcaaaatttatctcaaatataacaacttcacttacattctcttatcaaccaatcacaaccttccacgattcaaattctccacctatttactcttaaccaaccacaactttcccccattatacccatgtacaaccctaaaactccttatattttgggacagagatagtaagttttttccatagctgcatttgttcaaagacaaatttcctgtttttgttattgataacaggaggggctggtccaaatattttgtaggtcttatagcaaatagtacattagtctttttgtctttaatgcataatggatatagagagcttttcatttgaatactggtttctgtacattccaacgttgtgtcattacacatatttaaatatgaattatataatttgcatatgtttgcaaaactacaatctgcatatgttggggaaatatccattgaaaaccatacctaaatgttctctatattcatgaaaaaattactagacataggtatagggatgaaatacattcacaccaaatctcaagtctaaactccggtattttttttcatgaatttatgtcgaacttttaggtccggttttcacgagttttcacttgatggttttcaccagatatgccatgcatatgtttgcaaaactataaacgtaattttaatgttaattggggtacacaatatggtgggcaaagtgttcttagaaagaactgaaaaaataaactatgcatgacatgttttaaatagggaaaatttgctctaggaaattacagttgatgtatttgctgaaacgtgctgcaaatacatcattggccttttctgcagaaatggctatcacaatgttgtagccatttctgctgtacttcattggcctttgctccaattgagcatgacaacaaaaaaaaggaaaaagtacatgtgaggtccctcatcttatcaccgaattacaaaattgtccctcaaccgaaaaaccagatatatgatatcccttatcttacaaaaccaggtcagtttatgtcctttggcggtattgactccggttttatcctatgtagtaactgagtcagcatgggcccacatgggcccaaacatgtcagggacacctccgtttcttctcctttgcccctctcccctctcttcccgatctctttccattgtgcgagacctccggagaaagcggcatgtgcggcagccggcggagaaagtggcgtgggtagcagagaaagcggcgccggcggagaggagttgggcgacagcggcgagaagctcctccacctcccaccgcagccaggatccctcctccacgccttcctcctctgcaagcgatggcgcggccacggcttcctccgtcgcttcctcgactgccgcgtgcggtgcgcagtcgcggctgccctacgcagcaccagcggactccgcccgagctcctccaacgtcgtggcctccgcatgcgccacggtggcccgcaaggccatggccacccagcatgcatgcaaagaagttcagtagcctgcctgatgctgcagctactatgaaaggggggtgatttcgcatgcgtacccaaacgagctatcttagcttactcactagaggtgctcaactcaactaatcagcaactagttcaaatcgatctactactgatccgtcagtgatcagtcgtcgtcaacatctattgatgcaaagcagctggctatctatcaatctggaatgcagagattaattgaattcaaccatccgtccatgaatgatcggttctcgtcgtcatcagtgggtaccgattaattgggctcttgctccgaatgggtgatgcactaggtctgcacggagagcagcgcgtgcggcagccggcggagagagcggcgtgggcggccgccggcacggagcaaccggcgcgggcagcgaataaagtgatgccggcgaagaggagttgggcggcagcggcgagaagctcctttgcctctacgtgtggtggtcagcggagaaattggcgggggcgacgagaagctcctttgcctctacgtgtggcgtgcggcagccagcggagagagcggcgcgggcggccgccggcatggagcaagcggcgcgggcagcgaagaaagtggtgccggcgaagaggagttgggcggcagcggcgagaagctcctttgcctctacgtgtggcggtcggcggagaaattggcaggggcgatggccgacacggagaaagtggcatgcagctgcggcgtgagtggagcgggcacgccgctgccgttgctatcgtccacgacctgaaccctgcgggtaccaggaggaagagcgggtggaggtgccggggtagttggttggcctcgcgctcctcgctgatgctcatcgccgccaacacctggcctttgtcgcccgccgggggaaggcagcgtatgatgggtatggaggtggccgcggactcatgggagaggacggggtcactgagcaagtgggagctggaggagcggagtgagacgtggagcttgtcggccgccggccgccccgtcgtctgtgtccgtggtgtcggggagtgcggcgctgctgccactcctcgtcaagattgacgggagtgagggggattggcgcgtggcgccacttcggcctggagctggggtgctgacatgttgggcccatgtgggtcccatgctgactcagctatcacgtcggatgaaactggagtcaaccagaatcaatattgcctaaggacttaaagtgatccggttttataagttgagggacgttatatatctgtttttttctttgtttggggatgattttgtgattcggtgaaaatatgagcgacctcagatgcattttttccacaaaaaaaatcgcttcatgatagacaaaaaaatatatgggccagataaccaatgcaagcaaaaagcaggagtccaacagcactttaaaagagtccatgaggaatttggaaataacaaactcctgttggcctattctggtatgttgtcatatttttccaatacctgttaatacttagtaattttatgaacgtttggacccagacagcttgaaccttactgctttcaagattctgtacatcagtttgtaattatgtgaacgtatggacttcgacacaaaaaacaactcatgcatgtaataattcccttgatatgcaaaactccaagcttaatttttcagtgttttagatgcaaggtttcttttgatcatttccttatgtggtctatatgtgcagggatggtgtgagcgagtctcaatttagccaagtactgaatgttgagcttaatcaaattataaaggtcatgctgtatcatttatttagtttagatttttttttttttttgtaaatctttttaacaggaatttcgcaatgcaggcatatcaatatatggatcaggggccaattcctaagttcacagtgatcattgctcaaaagaatcaccacacaaaacttttccaagaaaatactccagacaacgttcctccaggtgcagttctgtcctgttttaatacatctgatctgagggctatttatttacccccaataggttttgatgaagcactgtctttgcgaacagggactgttgtagattctggtattgttcatccaagacagtatgatttctacatgtatgctcatgctggacctatagtaagtcttcttgagccaatattttggaaatgattctgctgacatgtgatatttggggccatacattttcgtgctatatgtatgatggcattctgaaaattgtaaaatgtttgcctctttcagggtacctcaaggcccacccattaccatgtcttgctcgatgagattggtttcttgcccgatgacgtgcagaaactagttttgtcgctttcttatgtgtaagtacaggatagtttcctactttattcttgaatacacaaatcagaaagatgataatttgtgtggttgttttattgctctccctttctttgtgatcgtgcaggtatcagaggagcaccactgcaatatctgttggtatgttgatattcctagtcgcaatttgcttccttctgcattccggaacattatacctgcaatctgatcaatgctgttttctcttctcccagtggcacctatctgttatgctcatctcgcagcagcgcagatgggccagttcatgaaattcgaggaattcgctgagacttcgtctggaagtggtggtgtcccttcgtcatcaggagcagtggtcccagagttgccgcgcctgcatgctgatgtctgcagttcgatgttcttttgttgaggtggtgttagtcagctagtgtgcagcagggctgatccttcttttttttttgaaggaaccaaatacggagtacttgttaggcacttttgtagtactctagattgatactatgagatacatctaggttgggtagggagcatttttttttagatgatatagtgctcctaatgatatagttctgttagtgctcagctattaggaagtaaaggcttacccttgatggtaggtttatgaattcaagacgctaactttgcgccatatctaattgtcaaccagttaaacagatgattcgcacatgcctgtttcgctctcagttgtatccgcatcttattttttgcatttttttcatatatttgcaccatcgtgat

SEQ ID NO: 890 - DNA, 12618 bp, Oryza sativa
cgaacacggcgtcgaacgcgtcgaacctctccggcacgccctccaccactccgcctcccctgccgcctccgcctccctccaagtggaagcacctcacctcgtcgtgcccctccttgatccccgccagcacgtacagggactcgtgcgcggccaccaggagctcgcaggggtgccccgagaggagggcgtccacgaaggacggcgcgggggtcacggccagcacccgcgacgcgggggagagggcccccgccgcgagcgcgcgggggaggctgccgcccgcggccgccgccgccgccgcagcatcgaggaaggaccagtccttctccactacgtccgcgacggcgacgccgtccgggaccgcggcaaccgggccggcgcgacgggagggcggcgagcacgcaaggctgagccgtaggggggtaggaaaccccgggttgatgggtcgcgagtagggtcggggtcgcggggtagggaggaggagaggggagaacgccagcgagagggaggcggaggcggaggccatgggaggagagggtggtgttggccggaacgggaggaggatgggaaggtggaaaggtagacaatgcagtctcggcagagtgagtagtagcggtaactatgggccgggccaggaaaccatagccattaataattcggcccaattagctagttgctggttagagagttacgggcttctgaaatagtgtactgtatctcacggcctgtttgttacgggcttctgaaatagttacgggcttctgaaatagcggtaactatgtttggtactcttgccgcgagcccccgaaccgcgagtccatgaccaatcaccatccatggcgaagatgaatagttcatgccgagcaaaattttttttctgcacggtgattcaaaattcaaacagtaagtataatcaatcacagattgagcatagagatatgcatgaaaatgcttcctttttttcccatacaaaacgtatgccaagggaatcgtacgagtacgatggaattcaaacggtaaccagaaagtttcggaaattttcagtttttcacacaaaaggaaactgtgaccagaaaacgaggtgatcaccctgctcctggcggacccacacgaccagccgatcggacgatcgccgctgccagacaatgggtctacacgaatctcaaagcccaaagtttgaatcgtcccgctcttggccctcccggcgctgatcagtcttcgcccaatgacacgtgggtcccactgagagatcacagatgctgctgacatcgcgggaaggacaagccattgactagtctctaggctatccccaccggagagaaaaagaagaccaacagaactgaggatttgaggaaggaaagtgtccgtcactgcaagtggggcccactcggaagccacgaccccctcttttgcatgagctgcggcgagcacgggcccaccgcccaccgcccctgctctctccgatttccattccaatcttccgcgtcggcacgagaccacgacgtcacgcattcccgcgaatccggcctgctcgagacctcctcccgtcgcgacgccgcaagccatcaaagcgcctcctgcttccgctcctatccaaggcgaaccacactctgcgatcgagagctcgctgagccgtaaaaccctagctaatccttctctctccccccctctcgctgtcgtctccgtctccgtctccgatctccgcggcctcggttgcgggctgcggctgcgccggtgcggctccatggtcccggagccggctcccgcggcggcgacggagccgaggcgctccacgcgcaggcgcctaatgacggccgccgcgatggaggccgaggcggaggcggtggccgacctcgacgagatcgaccgcgagatgtcgcgcgccgagtcgcgcaagcgccagcgcaggacggcgaaggagaagcctggtgcccgtaagggagcgaccgaatggaagccggaggacgtggagaaggcggcggcggcggagggggtggccgagctcgacgagatcgaccgcgagatgccgcgccccgagttgcgcaagcgccagcgcaggacggcgaaggagaagcctagtgcccatgagggagcgaccgaatggaagccggaggacgtggagaaggcggcggcgcaggagcccgaggggaccgagctcgacagtgggttgtcgcccgcagagtcacgcggcaagcggcagcgcggggtggagaaggtcaagcgtcgtacccgtaagaagacggccaaggagaagacgaaggagacgaccgagaagtcggcggctcaggcgcccgagaagatgaaggtgaacgatgcgggtggcgcgctggccgaagacgtgtgcgcggatgagccggacgccgaacagatggccatggaggaggaggaggaggcagccgacgtgctggaagcagaggagaggatgggtaagtgtgtcggagaaggatcagccgagaaggctgcgacgaggaagagggtggcgcggccaagcactgcgagaagggtggaggactcagatgaccactttgtgggcgatccagtaccggatgatgaagcgcgacaacgatggcccgtgaggtacagtagaaaggtaagaatttctagtaaacctctaactctattctagagttatctcctggaatactaaagtttgttatcacttcgattttgagatgattttgaaaaataaaactgacatgctcttttgtttttgttgcaggggtctgattcgcttcttaagcaggagtatgtgtgtttttacgctaacattgttctgaaagtactcttaatctcttcttatgctgcttttataatggtgatcagaattttcatttatgcaggcctgacgaagatgaagaaatgaaggctcgatgtcactacctggctgctaatgtggatgatgaaatctatcatcttgatgatgatgtctatgtcaaggtcagtcatgaatatcttgttcacacttcttagaactttattaaccaatgttgtttcctagttttatgtattgcttttacgatagcatttttatatgactgactaacaagggatgattaatgtaccttttactttctgccatttttgttttgctcttcattataattgttattaaacttattatcctactatttgttctactggttgttaaccacgagatattaagttttcgattaatttgttggcactcattttgtacgcacgtaaattttctcatatcattgttctgtgcatatcaattttgtgtgggaaatgggtacataacttgatttgactgtggagattaataagaatatcatttcgtttggcttgcatatgctctatggtgtatcgttgtaaattattcatgcgttatctatttgcttatcatatgtcttgtctactaggtccatatgaaccaaactaactaatttgcaggctggtcctgatgaggaaaattacattggacggattactgaattttttgaaggagtcgaccgtggatcatatttctcttgtcagtggtttttccgtacagcagatacggtatgtctgaactctgaagtacctttttgttgctttttaatggaaatgtaacacttataagagacatgtatttgcaggtcatctcatcaaagttgttaaaggtgcatgatcatagacataaccataagcgtgtttttctttcaaaggagaagaatgacaacttgattgagtgcatagtctcaaaagtaaagattgcccatgttgatccaaatgtaagtgatatattcattaggcatatatcctatttaatgcttattatgttgtcatgttacagatgattttttgttgttgctaatatttaaacaaattcagatgacgcctcaagcaagagctcatgctatatctgattgtgacctgtactatgacatgtcttactctgttgcatattccacgtttgcaaatcttccagcaggtaattgtttacatgattcttttcccattgcaattatcataggtgtgtatgtgcatcattcactttgttgttaacttacataagagaccttttatgataaactgtatgagaaaaatattttatattatattactattttgaatatttgacagatgcaaaaatacacttgttgcttcaatattgtcaatctcaatgtttattgtcttatcttctgagggagctattttcttgtagataatgatggtgcattggggagtgaggcaacatcaaatatttcctgcgatgatgctgacaattcttctaagggaaaattgtcggctgatattgtggcaccatatagtgaacaaacagagacagcttctctgcttgatctttactcaggatgtggcgctatgtcaactgggctttgtttgggttttgcattttctggcataaatttagagactgtacgttttgtacttggtgtgactcctaactgcctactaagctcttttgtctattgacaatgttaatacttgctttattgtgcagaggtgggctgttgacataaacaaatatgcttgtgcttgtctcaaacataatcacccatactcgcaggtagtacattcctgtttccacttgtgtactgccactagatagtatcaccttgcacatccaccacatagacaaattcatgtgtttgcttttgcctctactttgtaggtgcggaacgagaaaactgaggattttcttgcccttattcagcagtgggatgcactttgtagaaaatatgttgtccacaaaaacgatacactagaacctagtatagatatgcccttaaatgatgctgacgatgtaaatgagcctcttccagaagatatattcgatgtagaggagctccttgagatatgctatggtgatccaagtaacacaggaaaaaatggcttgtggtttaaggtaatagacttaatgtttactagttaactagcattcctttaatttcatatttatttgtattaatctagtgtggtactatattattgaaaaagtaccctgtgaattatattttatataggtgcggtggaaagggtatgatccaagttatgatacatgggagccaattgatgggctcaggttggtatctctttcattatgcccctttcacattttttgttttattgttagtgcctaatcgttacaaatttcagtgattgccctgagcgtattaaagaatttgtagagaaaggacacaaggaaaatattttgcccttgcccgtaagtatctttctcatcttctttttttccttttcagttttgttgtcatgccatcttatcatgtcctttaaattcgtaagggtgctgtggatgtcatatgtggtgggcctccatgtcaaggcatcagtgggttcaaccgattcagaaagcataatgatccacttgaggatgaaaagaacaaacagttggttgtttttatggatatagtgaagtatctgaggcccaaatatgtcctcatggaaaatgttgtggacatattgaaatttgcagatggattccttggacgctatgcaatgagttgccttgtggctatgaattatcaagctaggcttgggatgatggcggcaggatattatgggctaccgcagttcagaatgcgggcatttctctggggagcccttccatcaatggtttctctctatgctttcttaatcttattcctttgtgacacttttgcatattaagatgttacattcaccaataggtattaccaaaattcccacttcctacccatgatgctgttgtgcgtggaatagtaccaactacattttcggtaagagaattgagtaaataattgccaagatttcattattgtattatgtattgtcttaatatttggctgctccatttgcagcaaagtgttgttgcatacaatgaggtagacacccgttgcctacgaaaggctcttctccttgcagatgccatatctgatttacccaaggtttgtgttattttcatatatccatggatctttatcttttgaatgctgattggacaattgtgttgttctttttttgtatgtgctatattacaaatttacaggttggaaatgatcaacctaaagatgtaatagagtatagtgttgcccccaaaactgaatttcaacggtatatccggaacaaccgtaaaggtagtccatgatttgttactaattgaattaacaaatatcgataaatactgttcatgaaatctactccctccgtcccataaaaaaacacacctaatatgggatgtgaaacagtctgttcagattcgtagtattaagatgatccatatcccttactaggtttatttttttatgggatggagggctatgttcgtttgttatgctctttccctctgcatttgtggaattctaactatttaaattttcattagtgtgtgggtttgacaattgccttgcccgttggtttatgcaattctaagtgttgctacttgtagtttcttgattgaatttctaggccaagttactttgttttgttattcattttcagacattcaggattactcttttcgtggagatgatccttctgaagaaggtaaattgtttgatcatcaacctctaaagctaaacaaagatgattatgagcgtgtgcagcggatacctgtaaaaaaggttagcaaggcttaagattgtcatgccagttactttcaataccttggttgcttacctttttttctgtttcagggagcgaactttcgtgatctaaagggcgtcatagttggcccagataatactgtgcggctggatccaaacatttcccgtgaacgactgtcatctgggaagcctttggtacttttatattttgctatatttcaacaactgcaatgtcaatgtttcctcttttgcatgccattaattactgcttctctggataggtgcctgactatgccatatctttcgtcaaggggaagtcaactaagtaagtacgttgagcataatggttcattttacacaatcttgattgataattctaattaatctggcaatgcagaccgtttggacgcctgtggtgggatgaaactgttcccactgtagttaccagagctgagcctcacaaccaggtatcattttttttttggcgtttttcccatcttaatgccacttcggttgtaattgtgcataaacggactcccccatattgcagattattttgcatcctagccaagaccgagttctgactattcgcgagaatgcaaggttgcaaggttttcctgactattacagattgatcggcccactaaaggagaagtaagtgcttataggatgtttgtatcgattgtagtggattcaggaatcagtaatatggactttagtgtccatattttggattgaattactcacagatataatagtatatgacagatgagtgttgtgtagttccattcttatgctatgtattcttgttcaatgtagatatatccaggttggcaatgcggttgcaattccagttgctcgagctttggggtatgctcttgggctggcctaccggggtgaatctgatggagatcgagcagtactcaaattgccagagagttttatttatgctgatcaagagacggttgttaaatcttcggcaggaactcctggaagtgaaatagctgattcggaacagttgtttgaatagtatgttatctgagtcacttgtatagttgggtgatgtgctataattgtttctgtatgagtttcgaacacggacagtgcatgcattgtccaatgctccaaacattcactggttaaccctggaactgagtaatttgcatacgtttcttcattggatgtccatttctttctggtttagatatgtgagtgaaatactttatttgcttcgattctaattgagctgctgctacattgtattatcgggctctttatttaatgggatactggctacttttgagcaaaatctatccttatgctcttgtttttacttgtatgaaatttccctgtcctgtctgacgttacacaaagatgcatggaacgatagtgttcagtacaccagtttcgatgctgttttcttatatgggcataagttatttgttatttgacaactgctgactgttaatgaccgaagattcagtcactgtttttttttactgatacaaaattcatttaatttctattactggctctttattaaaagaaagaaaagaaatctacatggcacaaagcatttgcatggtaatatacataaactccttttttttttggagtttttcatggacgggccctgattggctgttagtactgctggacagtctcagtacttcagcgaaggcagatgtatttactttggagagcctggcatctgcgaaatgacgtgatccatggtaaaggaaatgcatcaatagctgactcggctagcttcctggtaagctatgaaaatcaattgtagccgatccgacaacgggaagatgatcacaaagggaagggccctatgtatatggaacataataaaaaagttccaactacaagtatgaacagacaggctgacagatggtgtgcgccgccggaatatttcgctaaactgaatgttgacgctggttacagagaagagtctggggatgcaagcgtcggatttatattcagagactgaaggggttggtgcttcttgctggccacaaaaccttgcatcaatgcggttcttcggcccaggcggaggcgctagcatgtctagaaggactgtgatcggcggttgaattgatccacatgccaattgtgatggagatggacaatgctgaaattgtcgatggcataaaacaacaggggccattgaaatcggcctgggcgacgacaattgaagagattaaaggagtgatgtagtgtttccaacaagtgcaagtgcacaagataaataggcgacgacaattgaagagattaaaggagtgatgtagtgtttccaacaagtgcaagtgcacaagataaagagagaagcaaatagggtagctcatgttttagcacaaatggcaatgagtactagatctcgtgcggagtggaaaaaaacataagctctttttttttttttgaatctacacagaagctcccttgaccaccaatgataatgatgtttgtcagctgagctccaatggttgggaacgtcccagttggcatggagaccaaaaatagaaaatataaagagattgtatcccagaaatgcgcgcgaggcggtgcggtggaggttggacaatgtgacgaaaccagcgctttgaagcctacttccttttcccttcccaattctgcttcaaccccttctgtttttttcagaaagaacagggaaaaaggaaggtacattattgattcttcaatttcatggcatttcaattcctctatttgtttggtactctgaatgttgtattcgatctcacctccagtttcataaaccccaatttcttttgcatgatgtttgcttttcttaaagtgaatgtggttattcccttgatcctagattctaagatgtaaggtaaagtagcttttgaactatcttccttgatgttccaggattctaaaatgtaagataaacaaaaaaaaaaggactgcttttcagcgtgtagttctgtatgaatggacatgttaactaaaccaaaggtctgatgaaacatgagacaagtccctcaaatgcagataaaatcctcaaatccctcactatcctctcccatggttatgcatcctttcttttttttttccttttagataatatcaccatttttttcctcccatatttttgcaggggtttatcgcgacgaggagccgaggagggggaggcgcgccgcgccgttccattccagaacatcctctcgtgggaggggtggaatcgtcttgatcatcgccggggcgagatccgtctcgacgtccggcgggaaatggacgattccccgctagataatctgtttgatggaaatggattggattcatcggcaggcgcggacagctctagctccacgggatcaccgccgagctccacgtcgtcgtcccctccgtcgtcgcagtcacctcctccggggtcatcgccgcctcctgccagcccgccaccgtccacaccgtcggccccaccgaccaattcctcgggctcagcaccgtcgccaccttccccgtcgcagtcggcgccaccggcgaataccggcggcggcgggtccccaccaccatcgcatggctcgccgccagcgccaaaggccgtccagtctcaacccgctccgaagcgtagcggcgacggtggctcctcctcggacagtgggagctccaaggagggaggcagctcgagtgaccgtggcaagagcgaaagcaacggcaacaggccggggccagaggctgccatcatcgccggcatggtcatcgggttcttcaccttcgccctgctgctggccatcgtcgcctgcgtgtgctgctccaagaagaagaagagacctccccacatgcacatgccgtactacaccgacgagaacggtaagcacacatctacacgcgacgcgacggcatggtgcgctcgccacgcatgccgcagagagatcttgtgcagttgacatggggtgcgctcccgcgtccgcgtgcatgcagggaaagtgtactacgcgaacagcatgcccaggtggcagaacagcgtggaccaaggcggcggctggcacgcgcagtactcgccaggccaggcgccgccgagcagcgagatgagcgggtcgcacggggcggggccgctgccgccgccgtcaccgggcatggcgctggggttctcgaagagctccttctcgtacgacgagctggcgctggcgacgggcgggttctcgtcggcgaacctgctggggcagggcgggttcgggtacgtgtacaggggcgtcctcgcgggcagcggcaaggaggtggcggtgaagcagctcaaggccgggagcgggcagggcgagcgcgagttccaggccgaggtggagatcatcagccgtgtccaccaccgccacctcgtctccctcgtcggctactgcatcgccggctcatcccagcgcctcctcgtctacgagttcgtccccaacgacacccttgagcaccacctccacggtctccatatctttcctgctcttttcccagccatcgtaacgcgccattcgtacgtgagatttttgttcgattctgacacgcgcgtgtgccggatgcgtgcagggaagggcgtgccggtgatggcctggacgacgaggctcgccatcgcgctcggctcagccaagggcctcgcgtaccttcacgaagattgtaaggtccctaataaacttttcgtttaatttgcagtctgcagggacaaatcctgtctgtacgtccttctaacgatctgatttgttgcattgtggttgtcacgtacgaaggccatcctaggatcatccaccgtgacatcaaggcggccaacatcctcttggacgagaatttcgatgctaaggtgaacacaccagcttgtttaagctgcgtttaagattgaactagctagtcctgacttgtttgaattcatttgcattaggttgcggatttcgggcttgcaaagctaaccacggacaccaacacgcatgtctcaacgcgcgtcatggggactttcgggttagtgcaacatgagaccgtggctcgctcgttgacatgcatgacggacgagcgggcacggatgacgagtcccagttacatgtgtgtaggtatctggctcccgagtacgcgtcgagcggcaagctgacggacaaatcggacgtcttctccttcggcgtcatgctgctcgagctgatcaccggccggcgaccggtcgacccaacgaactacatggaggacagcttggttgactgggtgagcgtcaccctcgcctccatcgcaaactaccactactacatcctaagcttacatacgtggttctgacacgccggccactcgatcgcttggtcgtgacaggcgaggcccctcctggcgcgcgccttgtcggaggacggcagtttcgacgagctgatcgaccagcgcctggagaacaagttcgaccggctggagatggagcgcatggccgcatgcgctgccgccgccgtccgccactccgccaagcgccgcccaaagatgaagcaggtaattgaaaccgcacagctcacagtgatcaaactgatcatcgatcacctggttgcctggcaatatatgatattttttcttctttgcgtgtattgcagattgtccgtgcgctggagggcgacgcgtcgctggacgacctgaacgaaggggtgaagcccgggcagagcatgatgttcagcacggggtcggagtacgactccggcaactacgcttccgacatcaacaggttgaggaaggtggccttcgagagcagcatcgaggacagcagcgagtacgggacccactccagcgccgactcgggggagccaccccggcggcaacagcatcgctagccgtatgatcggaggcgtcgagctagacttgactatttcttcggtgcgtgagtgtggaaagtggaaactgtgtggtgttgcgagatggcgaatcatcgatgggaaccggggcgtaccgtgtatgtgggaattgggatactgtcgtgcatattgcaggccgatcgtttgacgtgactgctttgttggctgtattatcgtgtgatttaatgatgtatccgatcgatgagtaatgcgatattgcgcttatcttgcatata

SEQ ID NO: 891 - DNA, 5200 bp, Oryza sativa
tcactatgaattctccaatatccacttctccatctttctcctctccgatgccttgtgttgatctcttatcgtctctagcgtcttctcgacctcggctaagagcaccgccacaaaaacattctatttggacgctcacaatactatctttatcacctaccattataatgtctggtatgtgagaatcctctattataatgtcactaccattataatcgctggtatgtgggtcgcatcctcttattgctccacatattagtgtctgtaatggtagaacataatggcactaccatcagtatatgtaatggtagtgctattatggtagaacacaatgacacttttattacagatactaatgtgtaaagcaataagaggatgtgaccatcgccaataactactgtcgatattttcttgttgcgttcggtagagtgagattgcgagtttgtttgtttcgttttccgcgcgcacacttcccgaactactaaacaatatgtttttttgcaaaatttttctataggaaagttgttttaaaaaatcatattgacccatttttgaaattaaaaatagttagtattcatttaatcatgcgttaatggctcaccttgttttgtgtatcttctcgatactcttctcctcgaactcagtctcctctaaatttaaattggagaacactcgcccctcctctttctatatcatgactcgatcaatccatcttgtttaaccactagtgggacgctactatatctaagttttacgttaccgttggtaaccgcgccgttaccggccttaccgcgggggtacggtaatagaaataccgcggtaacctccttaaattcaaataaaattaaaaaataatttgaatttttgataaattttatacgggtttgtacggtttttcacggttaccacgcggtaaccccggccccggcggttttggaaaccctgactatatctcatagagcttatcggaggtcgccaatgcgcaaaatctatttaaaaaacatctaatagtgtatcggaaacatatacaagtgaatggacaaaaattaatcacatataataaaaaccaacaattattcatatataagaagatttcaacgtgtacttaaaaagttaggtgagaatttatctggttgaaacaacaaagtgcttgacaactaagagttgaagcctcaattattgcaccaacgataagttcacctacttttttttctctctcctcccaccttccatggaaaaatgtgctgcgcacaaaaggaatctatggccactttggtgtgcagccaaaaacatccagaaaaacctcttgtaggagggcggaaatgcgttcccacagctcacctctccgcagaagatccttgtgtctgtatcgtccacagagccaagcccttacaccgccctgtgaacagtcactgacaatcctggcccacgcacgggtgggtcccacccgtcagtgaagtggctcaggcgacatggtcgcaggcgcgcctgtgggtttcgtctacactagtcgtcgtcgagaggcgcggaggcaacgccgtgtggtcgccatcgccatcgccttcctcctcctcctcctccgccgccgcgcgcttcctcgccaccgcgcgcccagggccatcggcggcggacgccctcgcccacgcgcgcgagagaggggggcgagagattatcggacgagtcgctttgcggagctttctagaatggtggtaagggctcccgctccccccctccgaagcctcctcttcctctctcctccaatctccatcctgctgctgctgcatgatgttagtttggccgtgccgcggcggacgaccctcctcgtcgttgttcgtggattgctccgtgcacgattaggttgtgggtttccgtttgggattgggatggaggggctcctctggtctgtttagtcgcgaaagaatgatactttcttgtatgttttgctgcattttggatcctaaaattatctgatactgtattgatgtcgcgcttgagaattcgattttgcgatgtcgcgtgaacagttcgggcttgcggagcgtggaggagcagaatatttccccccttttgatttggatttagggtttaactgtttggctatccccttgaaatttgatgagggctacgtgatataggggtggcagtatgcctcatacaagatgctacattcaacccgattcagtacttgcgttaatttttctcctctgaatcgccttgttttcactgttagtcgggatatttcagacgtgttgcttaatttatgtcacaggactgggcttcagatagcgacaatgataagttcgagtgggacacagacggtgaggctgagacctcatctgccccggccctaaggaacatagatgctcctggtccgtccacgaggctgccgcaggtaggagatagaggtctatctttgaacacacgtgctagtcatttgttcaaaccatgttgttactttactgtaattataatcaaaatgtggtgtttgtttgtggaactgtctgaaggatgcaaatgggaaggccaacgggtcaggtgctttggttgctgaatttatgggaatgggattcccaaaagaaatgatcttgaaagcgattaaggagattggtaacgataacaataatctagttctcttatttgcttctggttgcattttgaatcttctgtttcaactgctgtcttttctttcaggggatacagatacagagcaattgcttgagttacttctgacttatcaggtatttgcccacatggttgcatcactctgtttattattatctaatgctctactgtacaagtgatgccgtgtaatgcaggcaataggcggtgacgcttcagtgggtaactgctctgcttcggcctgtgccccccagactcttgaagtcgacgaggaggaggatgatactaattgggatgaatatgatactgctggcaattgtgacaggactcctcactctgatggttctggtgacgaggtatttacatgaccccctccttggtcattatatatttatatgcacttgctgtgtctatttcttgaccagtttccctgatcatggctgcaccattttttgcacttgcttcatgctaagaacacattcccttattaatacctatgtaagtgaactactggtcgtataataaattagaaaatttcatacctgtgttctatttcactcttagtaaacaagtatagatatggttagctatactgcagtgctgtagtcttttgtatctataaaaccatacatgtccctgtagggttgttaaaggagctttgttgatccagcccttccttccatcattctatgcatctccagttagcattttctttatggtgcctttgtagtgagagttagcagaactactgtagaaccatcagagagaggatcatatatttggtagcagtaaattgtaggctttgcaaatggtatatgtgtataactgtatatgtgatgcctgcattagttgctttattaataggttattctggactgcaagtcattagagagatgtaacaagtgttttcaatttgcctttaatgtgcttttatgcaggatttctttcaagaaatgtcagagaaggatgaaaaaatgaagtccttagtcaacatgggttttcctgaagatgaagcaaagatggctatcgatagatgtggtatgcctctattgaatttgatgctttgacaggaaggaaccttattctgctgcctttgttggcttaaatttcccaggtctcgatgcgcctgtagcagtgttggttgattcaatctatgcatcacaggaagcaggaaatggttactctgcaaacttatctgactatgaggtaccttgtgattataatgcatctgaatcaataggttgtttcatttcattaaatataacggcattggcatcatctttataattgtgcaggatacagagttcagttcctttggaggaagaaagaaaacaagatttgtggatggaagcaagaagagaaagcggtatggaagtgggccatctgggaatcaagtgccgtttgatggcagccacgaagagcccatgcctcttccaaatccaatggtgggattcagcttgcccaatgagaggttaaggtcagtccacagaaatcttcctgaccaagctcttgggccaccattcttttactatgaaaacgtggccctagctccaaaaggtgtatggacaaccatctcaaggtttttatatgacattcagcctgagtttgtggactccaagtacttttgtgctgctgccaggaagaggggttatattcataacctgccgattgagaacaggtcacctgttctcccaatgcctcccaaaacaatatctgaagcctttcctaataccaagaggtggtggccttcctgggatccaaggaggcagttcaactgcttgcaaacttgtatggcaagcgcaaagcttacagagcgaattcgttgtgctttgggtagattcagtgatgtaccaactccacaagttcagaagtatgtcttggacgaatgtaggaaatggaacctagtttgggtcggaaagaataaggtcgctcctctagagcctgatgagatggagttcctgttagggtaccctagaaaccacactaggggagttagcaggacggagaggtacagggctctcgggaattcattccaagttgatacagtagcataccatctctctgtgctgagggacctgtttcccaatggaatgaatgtcttatccctgttttctggtattggaggagcagaggtagctctccacagactggggatacatatgaaaacagtgatctctgttgagaaatcagaagtgaacagaacgattctgaagagctggtgggatcagacacaaactggaacgctgattgaaatcgccgacgtgcggcatcttactactgaaagaattgaaacattcatcagaaggtttggcggttttgacctggtgattggtggcagcccgtgcaacaaccttgctggcagcaaccgccatcaccgagatggtctggagggcgagcactccgcgctcttctacgattacattagaatattagaacatgtaaaggctaccatgtcagcagtctagtttaagctatcacattaactaactctgtgatttattgttgttaacgaagttagaacctgttgattgatattgctgaacctgatgtgatgttattgcactcaaacaggagtgttttttcc

SEQ ID NO: 892 - DNA, 4252 bp, Oryza sativa
ccactggcgtgctgtttttccttgctcagaaccccatcacctggcaatctcaaaagcagaaggtggtggcgctctcttcttgtgaagcagagtatgtggctgcgacaacggctgcgtgtcaaggggtgtggttgcaggggctccttagcgaaatacttggagcaccggcgacggcgccaattctcaaggtttacaacaagtccgccattgctctatcaaagaacccggttcaccacgatcgaagtaagcacatccaaactcgttttcatttcattcgagagtgtgttgatgacgggaagatcatcatcgagtatgccagttcagtggagcagctagctgatctgcttaccaagcccttgggaaggcagcgtttccaggagctgagcgagcttgttggtgtgatcaacacaaaaggccaaagttgaacttcacaagatttagggggagatttgttacaaataaacttgtgtggatctgctttgtgtttttggttctggtagtttttccctcccctatttttctgttgattctgttagagtcacgcacatgacctcgctggtttttcggccgtgtgcgacgttgggctcgtcgtgtgcatttagttcgcacgggagcgcatcatgcgtgggcacgatcctggtgattgggatggcagtcgccgttgagggatcgtgtccgcatcaaccgggccaacgtgcctatgatcttgtattcgcagaataaaaggaagaagataaacagaaaatgctgctcagttgttcgcagcgccaaacatttgtgttctgtgtgattgctgttcttctctctcgcgtccacgttcgcgtgcgttacgggttttttgctaacatcctcctcttccgccgcgcgcttcctcgccaccgtctctaggccggccattggcggaggagagggaggccggcacgccgcggagcagcaagagattgttgcccgaggcgcttctcggaccttctacaatggtggtaagagctccctccctcctcccctctcctccatccatgacgtcagtttggccacacccaatggttcccgctgccgcgtgcaggcgatgcgcttgtgctgctgctgttcgtcgtgtattgctccctctgtgcacgatttgtttgtgcatagggtttccgactggaattgggttggaggggcttctagtctgttcaatcgcacaaggatgatctgcattctgatcctaaaattatttcttactatgatttgtgatgtcgcgcttgaaaattcgatttgtgatgtcgcgtggtgcggactgcatgtggagtaacacaatatttttcccctttgtgatttgatgaggcgctgtgatatcggggtggcactggcagtatgccttacacaagatgctacattcaacccgattcaatctttcgctatttttttcctttcctctgaaattgccttatttccactggtagtagagatatttgggatgaggtgcttaacttatgttacaggactgggctagcgacaacgatgaggatagcgagttcgagtgggatactgatggtgagtttgaggcctcgtctgctccagccttttcgaacacggatgcacctggtctgtccacgagctggtcatttgtttaaaccatgatattaccttgctataattataatcataatatggtgtttgtctaaaggatgctaatgggaaggccaatggatcagcaccatcagctttggtggcttactttttgggaatgggtttctcgagagagatggtcttcagagctatcaaggagattggtaatgataacaataatacatttcctcatttgcttcaactgttgccgtttctttcaggggacacagattcggagcaaattcttgagttacttctcacttatcaggtatttgttcacgtggttgcatcactttgtttattatctaatgctctattgtacaagtcatgttgtgtaatactgtaatgcaggcgataggcagtgacccttcagtgggtaacagctctcattctgcctgtgacccctagattcttgaagaagaagatgaggaggaggatgttaattgggacgaggatgatactgttgacaattttgatagggctacttactctgatggttctggtgatgaggtatgcacatgactccctccttggtcattatatatttatatcagatacttgttgtgtctatttctcgaccaatttacctgatcatgatcaaacctttgttatacttgtttcatgccaagcacacattcccttttagtgcttgtctaaatgatctattggtccaataaattggaaggttttgtgacttaagttatgtttcacttttatttagtaaactagtgtacatgcttacctgtactgcaatactatagtttttttgggttatctataaaacagtacctgttcctgtagggttgttaaaggagctttgttgatcctgctcttacttctatgtttctttagctggcatttttgtatggtgcctttatagtgagggagagttagcagaactactacaggaccatcaaagaaatgatcatatacttctacaaggtcgtattcaaaccaagcaatgatgaaagatagtctactggatgcctataattgaatggttgcaagttaagaccaccagacagaacaatgataaccactggctacatctgaacacataatagacaacaaaaaatagaactgaaatgatgcctatgagagcttaggtaatctgtgctgggcatttatccatgtgttgatgattgataagctgtactccccctcctttttgtggcctaacaggctttcttgtttcaccattttttgaatagttttactactttttcattacatatttagtatgagtttcctctaactttaatcctcaaaataagttcctctatagtgtggtagtatctgtttgcatggagttgtaagacgcaacaacaaatttgacacagaaggataatcgtatattttgttgcagtaaatttgggttttacaaatggtacatgcatatatgtgatgcctgcattagttgctttgttgggaggttatttcagactgcaattcatgagtgagatgtagcaaatgttttcagtctgcttgtaatgtgctttgttgcaggactttttacaagagatgtccgagaaagatgagaaaatcaagtccttagtcagcatgggttttcctgaagatgaagcaatgagggctattactagatgcggtatacctctattgaagttgctgctttgacagtaaggagccttatactgcctatgctgggttaaattttggcaggtctggatgcgtctgtagatttgttggttgagtcaatctatgcaccagcatctgcaggaaatgtttattttacaaacttatctgactatgaggtatgggtaccttgtgattatagagcatctgaatgatgaaattgttttcatttctttaatgtaatgccactggcataatgtttacttttgtgcaggatacagagttcagttcctttggaggaagaaagaaaacaaaattaatagatggaaccaagaaaaaaagagaacggtatagaagtagaccacaatggaatcaagtgccatttgacggcagccatgaagagccaatgcctcttccaaatccaatggtgggattcagcttgcccaatgacgggttaaggtcagtccacagaaaccttcctgaccatgctcttggaccaccattcttttactatgaaaacgtggccctagcaccaaaaggtgtatggacgaccatctcaaggttcttgtatgacatttatcctgagttcgtagattccaaatacttctgtgctgctgctaggaagaggggttacatccataacttgccgattgagaacaggtcacctgttcttcccattcccccaaagacaatatctgaagcctttccttctactaagatgtggtggccctcttgggatccaagaaggcagttcaactgcttgcaaacttatgtggcaagcgcaaagcatacagaacggatacgatgtgctcttggtagattcggtgatgcactacctccagcagttcagaagagtgtcttggaagaatgtaggaagtggaaccttgtctgggttggaaagaacaaggttgctactctagagcctgatgagatggaattcctattgggataccctaggaatcataccaggggagttagcaggaagcgagatatagagctcttgggaattcattccaagttgatacagttgcataccacctctctgtgctga

SEQ ID NO: 893 - DNA, 5716 bp, Oryza sativa
gcccttcctttgcctcgccgccgttgtcgggagatgacggcctggccctactcttctctgctcctctaattggtcccaaaccggcgccggcagcgcgtcgtatgccgccgccgccacccggagtcccgcgccttggcgtcctcgccgccaccgctcgggcctctctagcggcctgaccccgaggtcgcacgcgcggtgagccggtgacgctctcccttctcccgtatcgtcaacgatgccgccgccgccgccgcatcgccggcccgccggatgtcctctcccacctcgccccgacgagctccccacccgccgagcatcctgcagaggggaaagagagagagagagagagagagagagagaaatagagagagaagaggaagggggagaagggggaagggagaggtgctgactgtacaccctgacatgtgagacccacgtgggtcccacgctgactcagccgccacatcggacgaaactgggatcaaaaccaccgaaggacataaagtgaacgattttgtaagttgagggatgtcttatatctagttttgtggttggaggatgattttgtaattcgatgacaagttgagggaccttcggtgtactttttcctctatggcatgaataccaaccagtagatcgttggcgcctcattcccttcctcctgggccgcaacgggattaatggctagcttgaggcccatattattgttgggccgtaacgggaatgctagatacgtgcggcccgtcttctctggtagtcgtcgacaagacaagccaaggggagcggaggcgacgacgtccgaccatcaccgacctctcctcctcttccgccgcgcgcttccttgccaccgcatctaggccggccatcggcggaggagagggaggccagcacgcggtggagcagcgagaggttattgcctgaggcgcttcgcggaccttctacaatggtggtaagagctccctccctcctcttctctcctctcctctcctctccttcctccatccatgacatcagtttggccacacccaatggttcccgctgccgcgtgcaggcgatgcgcttctgctgctgctgttgttcgtgtattgctccatctgtgcacgatttgttcgtgcatagggtttccgactggaattgggttggaggggcttctggtttaccctttattcaatcgcacaaggatgatctgcattctgatcctaaaattatctcttactgtgatggctgatgtcgtgcttgtgaatttgattcatgatatcgcgtggatatattgcgaaccgcatgcggagaagcataatattttttcccttgtgatttgatgaggctatgtgatattggggtggcactggcagtatgccttacacaagatgctacattaaacccgattcaatctttcgctatttttttcctttcctctgaaattgccttatttccactggtagtcgagatatttggggtgaggtgcttaacttatgttacaggactaggctagcgacagcgatgaggatagcgagttcgagtgggatactgatggtgagtctgaggccacgtttgctccagccttttcgaacacggatgcgcctggtccgtccacgagacccaggctgcaagttggagatataagtctagttgaacacacacgagctggtcatttgttttaaccatgatattaccttactataattataatcataatatggtgtttgtctaaaggatgctaatgggaaggccaatggatcagcaccatcagctttggttgcttactttttgggaatgggtttctcgagagagatggtcttcagagctatcaaggagattggtaatgataacaataatacatttcctcatttgcttaggttgcattttgcatcttttgtttcaactgttgccgtttctttcaggggacacagattcggagcaaattcttgagttacttctcacttatcaggtatttgctcacgtggttgcatcactttgtttattatctaatgctctattgtacaagtcatgttacgtaacactgtaatgcaggcgataggcagtgacccttcagtgggtaacagctctcattctgcctgtgacccccagattcttgaagaagaagatgaggaggaggatgttaattgggacgaggatgatactgttgacaattttgatagggctacttactctgatggttctggtgatgaggtattcacatgactccctccttggtcattatatatttatatcagacatgatcgaacctttgttacacttgtttcatgccaagcacacattcccttttagtgcttgtctaaattatctattggtcttggtccaataaattggaaggttttgtgacttaagttatgcttcacttttatttagtaaacaagtgtacatgcttacctgtactgcaatgctgtagttttttgggttatctataaaacaatacctgttcctatagggttgttaaaggatctttgttgatcctgctcttgcttctatgtttctttagctggcatttttgtatggtgcctttatagtgagagagatagcagaactactacagaaccatcaaagagatgatcatatacttctacaaggtcgtattcaaaccaagcaatgatgaaagatagtctactgaatgcctataattgaatggttgcaagttaagaccaccagacagaacaatgataaccactggctacatctgaaaacataatagacaacaaaaaatggaactgaaatgatgcctatgagagcttaggtaatctgtgctgggcatttatccatgtgttgatgattgataagctgtactccccctcctttttgtggtctaacatgctttattgtttcaccattttttaaatagttttactactttttcattacatctttagtatgagtttcctctaactttaatcctcaaaataagttcctctatagtatggtagtatctgtttgcatggagttgtaagacgcaacaacaaatttgacacagaaggataatcgtatattttgttgcagtaaatttgggtgtacatgcatatatgtgatgcctgcattagttgctttgttgggaggctatttcagactgcaattcatgagtgagatgtagcaaatgttttcagtctgcttgtaatgtgctttgttgcaggactttttacaagagatgtccgagaaagatgagaaaatcaagtccttagtcagcatgggttttcctgaagatgaagtaatgagggctattattagatgcggtatacctctattgaagttgctgctttgacagtaaggagccttatactgcctatgctgggttaaaatttggcaggtctggatgcgtctgtagatttgttggttgagtcaatctatgcaccagcgactgcaggaaatgtttgttttacaaacttatctgactatgaagtatgggtaccttgtgattatagagcatctgaatggtgaaattgttttcatttctttaatgtaatgccactggcataatgtttatttttgtgcaggatacagagtttagttcctttggaggaagaaagaaaacaaaattaatagatggaagcaagaaaaaaagagaacggtatagaagtagaccacaatggaatcaagtgccatttgacggcagccatgaagagccaatgcctcttccaaattcaatggtgggattcagcttgcccaatgacgggttaaggtcagtccacagaaaccttcctgaccaggctcttggaccaccattcttttactatgaaaacgtggccctagctccaaaaggtgtatggacgaccatctcaagattcttgtatgacatttatcctgagttcgtatattccaaatacttctgtgctgctgctaggaagaggggttacatccataacttgccgattaagaacaggtcacctgttcttcccattcccccaaagacaatatctgaagcctttccttctactaagatgtggtggcccttttgggatccaagaaggcagttcaactgcttgcaaacttgtgtggcaagcgcaaagcatacagaacggatacgatgtgctcttggtagattcggcgatgcactacctccagcagttcagaagagtgtcttggaagaatgtaggaagtggaaccttgtctaggttggaaagaacaaggttgctactctagagcctgatgagatggaattcctattgggataccctaggatgttggataagtctttgtggtccttggtcgtgattcttctttttgcttttgggtagtttcaccttttcaggacagcatctaccctttagcatatttttcagttgctaggacagctacggttagtaggacagcagcagttagcatctcctttatgcctcctttatgctttattcagtttggatgccctctaggacagcatcccattcaaatttcgaattttagactaggagggtgcagcaataggctagtagccagctatggctatatatatgtatccaacctctctcgggtaggtatggcttttgtgttttgtgaatgaagaaaaccagaaaattgccccatctcgagtgccatcctcttctcaatgagagtaaccattgaaattctaacataggaattataccaggggagttagcaggacagcgagatatagagctcttgggaattcattccaagttgatacagttgcctaccacctctctgtgctgagggacatattccctaatggcatgaacgtcttgtccttgttttctggtattggtggagcagaagtagctctccacaggcttggaatctgtatgaagacagtggtcttagtcgaaatatcagaggtaaacatgacgttgctgaggagttggtgggaccagacccaaactggcacgctgattgaaatcgcagatgttcaaaatcttactgctgaaagaattgaactattcatcagaagatttggtggctttgacctggtgatcgggggcagcccgtgcaacaacctcgctggtagcaacagataccaccgtgatggcttggagggcaagcactcagcactattctatcactactacagaatcttggattctgtaaagactattatggctagcatgtaagctagcccattaacgaactctgtgaattattgttgctaatgaaattggaacctgatggttgaccttctttcacaaggtttctcttgccatggctcaatacgttctactaatttaccccaagtgcaaaatgctccttccattttgataatgcttgcagttttggtgcgaaaggtatgaaaattacatctgacaacatgtctctcatttttgtactactattatgtatacaaactgaagattgccatggaggaataggctaatgctattaaggggctttgtttgattactacaagctgaattatgaacatgatttgagcaccatacgctagattcatctctgcttttgctgaagttgaaattctgcaacctgaattgtacctgcatttctataataacctttatttattttgactgtgcctgaatgtctatagcttgcacctccaatgcaagtacatttccctttttcctgttgatatgcacaattcacttgatatatctttactataacaaaatcttgaatctttgaaggaaagttgtttcgccatgttcgcaaggcccttctgttgaaacaatcctcctccttgacactgaaaactgaacaagatccttccaataacagtgataaggattccatggacaaataa

SEQ ID NO: 894 - DNA, 5524 bp, Oryza sativa
gttttgggggagtaattgttagaaggaaaaattgcaaaaatgtacctcaatatcatcctgagttaagatcccctataaaatatttgttgcagatacttcctcctcttttctcgaatacgcaaaaggattgcacatcaatatattagaagaaatgaatatttgttacacacgcaatcagccagaccaacttatgtgaagaaagggagggaaacaaaagaccaagttactacgactccaaacagtgggaaaggcagagcccactactctcccaaaaaaccctaaaattagcaatgccagctaacgaccatagatggccctctgagaggatggattgtaggacctccgagaccgaagatagtgtagagttgaaaaccttggagttccgttccttccacagttgccaggaggatcagagaatcgaagccgggatggagatgctcaggcaagcatgccctagacgaaggccaccagatacactcatatttgaatactgatagacaagaaattccccgcacatcaagcctgagatgacacgattagcgcatcctcactcattgcactcaccacgttgttgggccacggcgatcgtaagtctccactatgggataccggaagatgagatgttgtgcttggctcatgggattcggtggcggctggtttctttggcacattcaaattcagtagatgattttggtatgacattgtgccgctaagaatgaagatgtgtcaagggccatgtccatcaagaacataacacaggtggaaagaggagaaaaaacacgggagcaaaattgattggggataaatctcaaaattaagatgaatgaggaggtatttatagcttagaggggaatctgaaactgagatgagatgatggttttgcaattttcaatttagggccatttgaatcagaaaaatttatatatgatttcatagtattcaaatcttaatggaatttttcctatgtgatcatttgattcaaaggttaaagctttccaaatcctatgaaatttatatgaaatggctcattgcatgtagattttggaggaaacttagtaagagttctaactgcttagaaatttttttagtctatattaatctctcaaccgatttctatttttcttacaatccaatcagacgactattcctatgttttacaattctctattttacacttgtattctaattttacgttcttttttatttctcagtttttccaaccatgcgatttcgagtgggctcttggattctgaactcccgtttatgctggcagaacatttcctacacgttgcaacgctcaacagacaagaacaaacgacaaacgcactgaataagcacaggccatcataaacccccatggagtagtacgaagcatcagctcgtcaggtcaaagctccctgacatgtgggccctacagaccaccgacaggtgggacccacccgtcatcatcatgaccgcaccaactcaactctcactccccctcacctccctcccccttccaccgtacacccccaaaacccccctgccttctctcgccgattccgccaccgccgccgcgccgcgcctcgccgccggccgcccttcgatctcctcctcctcctcggaatggatctctacatggacgactacatcgacccctacgaggaggccgaggcggaggccgccgcggaagccgccgggctgacgtccgcggcagcggcggaggactcctccgacgagggcgactccgaggacgactccgaggccgagagcgactacgaggagaggtcctacggcctcctccgctccggcaaccaccgcgtgcgcaacccggacggcaccttccgctgccccttctgccccggcaagaagaagcaggactacaagctcaaggacctcctccagcacgccgacggcattggcgcctccagcaagcgccgccgccacggccgcgagcgcgccttccaccgcgccttcgcccgattcgtccgcaccgacccttccttcgcccaagacctcgccgccatcaacgggatcgccaccactgctgatgctatctctaattctagtgctgccggtgccaaggagaaggcggatgccaatggcgacacagacggatccgcttcggtggcggctgtggccgcggggaatagacgggaggaggagaggtttgcttggccatggagtggggttcttgcagctggtgcagggttcaatgccgaggacttcgcggatagggtcgcaatgtttggtttggatgatgttgtgcctttagttgtcgatgatgcggaaggcgctgatagctttgcgattgtgaggttcgctaatggttggggtggattcggcgatgcgctcacgctcgagaaccatttcaacaagaataagcttgggaagaatgaatgggatgcaaggggtagtgctggagatgctgtgaagggagatgatggggacacagatgttaaggtttatggttgggttgcccgagaaggggactataatgccgggaatgtggtgggcaggtatttgaggaagcatacgaacctgacaaccatagatgaggtctccaagagtgaatcggaaaagtcggggaagatggtagcgatactggcaactcagatcgaggcgaaaaatcgattcttgcaggacttggagacaaaaaagaatgcaaccgaactctccattgcacggctcgaggaggacaacaggaagctacacgatgcatataatgaaggtatgatgtgcaactgtgcttcatttcttataggcgtagttgtcacatgcctagccatgttagctgagcttgtatgaactagaggaaatcaagacatgatatatttctttttctgtttgacggttgcactatcaatttgctgttgtgatgctaaaattcctaaatgtcagaggtacaggagatatgcatgtcatttgcattaagcaaagaataaatttgctacaaggacctgtggcacatgagtatccccatttgcccactgtcataacccatagtcattgtagcatgcgtgaagataacaagaaaaatctaagagtatcactaacagcagaactagattaggttgtaggtagttctctaatgcaatttgctcctgcttccatccgctgttcacaatcaggcctgatctgtaaccactggtcctgtaacctgtcatcgcttactggtagtttctccaactctccatacctcaaggacatgaattatctatagaatctacacagaagcagcaaatgatggattgtctctttgtcctagaggcacatgtcaaatactcaaatgattgattgtggaggagccctctgcactgcaactgttgggctatttagcttcagcctttatattagacatggattatttagagaaatagcatcctcttagttggttagactgttagacaaatagtggtcaggtctgccattatctatgtgattcctttcttgttttgttgtatgctattaccatataccacaagaccaacctggttagataaatgttggtaacagggacaaacacaataataatcctaatcattaactttcatcgcttagctagtaattgtattttcatttcgttataaaataaaataaaaactgtctaagacatcaatgtacgacgttgtaacaacatttatatttccatttcagaaatgcgcaatctacaccggagagctcgtgattatgctttaagagttttccaggataatgaaaacttgaagcttgaattagatagcaggaggagagaattgaattcacgtgctaagcagcttgaaaagataacagctgagaatgcaagcgacaggaaaaaacttgatgatcagaagcaaaaggtaatctaatgaactatctaggtgaaatactaagctacgatcatatgcacctctggtgaagtatcatgcctaggctatactgttaatttacatgatttgcaatacacttattttgaggtattgaatgtttctgttatgataacccaagtgtgtactgcaaatactgtatgtaatatatatgcttacttcctgaaatgtaatgtataggcaaaggatgataatagtgaacttgagctagcaagcatagaacagcagagggctgatgaagatgtaatgaagctagttgaggatcagaaggtttgaaacttttttttttacttctgttattttttcctgtttagcgggactgtattctcttatgatgagaattgactcactgatacaccttaaaaataacagagggaaaaggaagatgtccttgcaagaatgcttcagctggaaaaagagctgcatgaaaaacaacagcttgagcttgaagtaacacggctgaatggtacacttcaagtgatgaagcatttggaaggagacgatgatggggatattcatgataagatggagaaattgagtgaaagattagaacatgaaaagaaacgtttggaagaattgagcggagagctggtgaagaaagaacgtgaaagcaacgatgagttacaagaggccagaaaagaactgataatggtattactccatttctctatgatgattggcaaaattccttatacctatctgttctttatttctttaatgattgatattcatgaaaaggttttcatacatgatcataatcatttgcaattgacagggtttggaggacatgctaactgggcgaactgctattgggataaaaaggatgggggaacttgatgagaaacctttccaaaatgcatgcaagagaaagtacggaaacgatgactatgagaccaaagctgcggagctggtctcaagttggcaggaggaaataaagaagccatcctggcatccttataagattataacggttgatggcgaagataaggtatttgctctgctgttctatgttttactcttgtaccatctctgacattagaccctagggtttttttcgtaagtggtaaccatcgtcgaattttataggaagttgtagatgatgacgacacgaagctgcggcacttgtggatcgagtacggtgacgatgtgtgcaatgcagtgaagaccgccctgagcgaggtcaatgagtacaatgccagtggacggtatgttgtgcccgagctgtggaacttcaggaaaggccgaaaggcgacaatgaaggaggtgctcaagtacatctttggacagatagagacaaccagcaagcgcaggaggccgtgaagttcgtccttcgatggatgaagaagctgacaggcaagcgaaggatggtttgaggtgctgggtattggtgctaggtatcaagagctgctgccttctgttatcatctcaggtcaggttggaggcgctggtcaattgatgggtctaagttgatgaatactagtgtattgatcaatggatgcccataaggctgtgccaatccttagttataatgattatggttatggtcagtgtcaggctgtagaaataatcctgtgttgtgtccctttgaattgtagaataatcgtctgtaataatttcgatatactttcgtggtccaagacatcataaatctaagtgattagctactaatttttctgtga

SEQ ID NO: 895 - DNA, 3745 bp, Oryza sativa
actcgcaaggaaatcaaatgggaaggtcaaacagctggaaaaacagtgtctggagaagttctgtacaaatgtgttattgttcaagacctcagtatttctgttggtgcgacagtcacaacagaggatgattcaggagaaaccatcatgtgttttgttgagtatatgtatgagaaacttgatggtaaaaatatgattcatgggataattctgcaagaaggttcacagactgttcttggcaatgctgcaaatgatagagaggttttcttgactaatgactgtttagaatttgaagcaagtgacatcaaagagttggtgactgttaatatccaatcactgccttggggccacaagtacagaaaagagaattctgaagctaagagaattgaaaaggccaaggcagaggagaggaaaaggaagggcctgccagtggaatatatttgcaaaagcttatactggcctgagaaaggtggattcttctcccttccgtatgataaaattggaaatggcacaggcatctgtagctcctgtgagagaaaaccagttggcaatgaattcaagttactttctgagagcagctttgtctttgagaatattacgtataacatccatgactttctgtatatcaggcctgaatttttctcccaaggggagggccatgagacctacaaggctggaaggaatgtgggtctaaaaccttatgcagtctgccatctgctgagtgttcatggtcctgctggatcaaggaaagctaatccagaatcgacaaaagtgaaagtaagaaggttttaccgacctgatgacatttcatcaacaaaagcctactcatcagacatccgagaggtttgccttttttccatcatctgcatcattggcaatactgtgatttcacctaaacctatcttttttggcctttggtatttgattgttgtgtactttgtgatttgatccaggtgtactacagtgaagatataataagtgtacctgtggtgatgatagagggaaaatgtgaggttcgactgaaggatgaccttccaaattcagatcttccagcggtggttgaacatgtcttttgttgtgaatatttatatgatcctgctaatggagctctcaaacaggtcagctactgccaaatttttcttcagaatccctagttatctgcattgtttccactgggagatgtctttgtattattgaccgagcttgtcttgcatgatctttaaccagctaccgcccaatgttagacttgtgacactgacaaggaaggtacctgcttcaaaaaagaacaaaggaaagcaaatttgtgacattgagctaggtggttcagacaaaccaaaggatgggcaatcagagaactgtcttgcaacacttgacatttttgctggttgtggaggtttatctgaaggattgcagcgatcaggtatgctttgctcatgtagatgttgcttcataggaacattttgactccagttaccttctgaccattggattgtacaggattgtcacttactaaatgggctattgaatatgaagaacctgctggggatgcatttggtgaaaaccatccagaagctgcagtatttgtcgaaaactgcaatgtgattctgaagtacgccatttttgtttaccctctttgatatgcttatcatgtatatgtaaattgtatcttcagcacgtatctctatacgatcatgcagggcaattatggacaagtgtggtgattctgatgattgcatctccacttctgaggctgctgaacgagcagctaaactttctgaggacaagattaagaatctgcccgtgcctggcgaagtagaattcataaatggtggccctccgtgtcaggtcagttgctatgtggcttttgcctgtataccagggagctcctaacaacacattcgacattgcaagccaattgcttgaccttttgacctatccttttttagggtttttctgggatgaacagattcaatcaaagtccctggagcaaagtccagtgcgagatgatcttagcattcctgtcatttgcggagtatttccgtcctagattctttctcttagaaaatgttaggaactttgtctcgttcaacaaaggacagaccttcagattgacactggcatcactcctggagatgggataccaggtgcttgacacttcctcttcacttgtgcttgtgctatagcatttccatttctgtatacattctaaccttgtttacatgttcttaggtccgatttggaattttagaggcaggggcttatggtgttgcgcagtccaggaaaagggcattcatttgggccgctgcacctggagagactcttccagagtggcctgaaccaatgcacgtctttgctagccctgagctgaaaataactctacctgatggcaagttctacgccgctgtcaagagcaccgctgcaggagcccctttccgctcaattacagttcgagatacaattggggatctaccagctgtggaaaatggcgccggcaaaccaacaattcaggtataccctacatatcgcactagcttcactcgccaagttctcctgttcttaagctgccgctttatgtcagttgaataaactttgtatgatgtgctacagtacggaagcggtcctgtgtcttggttccagaagaagattagaagcgacatggcttcactgaatgaccacatatctaaagagatgaatgagctgaacctcataagatgcaagcacattccaaagcgcccaggttgcgactggcatgacctgccagatgaaaaggtactaacatttggccctctaattaacttctcctgcctcctgttttatttttaaactctgtaaacaccaattactgttcattgactgtgcaagtacaggtgaagctgtccacagggcagatggtggacttgatcccttggtgcttgcccaacacagccaaaaggcacaatcagtggaaaggactgtacggtaggttggactgggagggcaatttccccacttctgtaacggatcctcagccaatggggaaggtcggcatgtgcttccatcctgagcaggacaggatcattactgtccgtgaatgtgctcgatcccaggtacacataccaattttcacaccccatacattcactgctgcaacaggttaatgatgcttaactaatcatcaagtcattgactaacccaaacaaacaaattttcaggaagttttatccttcaaagtaaatttagtactacattttgtctcaatcagcactgtagcagtagatttagttctttaaccataaatcaatggatatattgtcatctctcttttcggcagaactgctttgtccattccttcttgaacctgttcaaacatgcattcattctaccgagatgccattattgcatctgcaactttgttgccctttttctgaatcttctgatctgtttctgaatcttctgatctgttcctacatgacactgtcaccattgtatgcacgcagggcttccccgatagctaccgtttcgctggcaacatccagaacaagcacaggcagatcgggaatgccgtgccaccgccccttgcctatgccctcgggaggaagctcaagcaagccatcgacgccaagcgttgagtggcttttaacttcactgcatcgccctcattttttggtcggtccaaataggtttaactaagcattacagttttctatattttgtgagcaattggactcctaaaattaattctgggatggttacatggattaccttttgt

SEQ ID NO: 896 - DNA, 3141 bp, Oryza sativa
ctccttggcaagcttgatagccacaatgacaagcacctgttattaaatccaaatggatacatttctgaattgcctgagaagctgattgaaaatgcaatggagtttctaaaatccaaaagaaatgagaaaggtcgttatgacattaaagagaaagagctaatgaagttactgaaagtcaagtacatatctagtcttgtagatcctggggaagctgttggtgtggttgctgctcaatccataggagaaccatcaacacagatgacgtaagatcttctatagactttctctctgtggtttttgattcactatgtattccaagtatgtacttggtgtattctagataggttatttatgtatccagtgcctggttagtttcttgagaaaaaaacagttttggctactttttgaaccatagtctaagtaaaatataatgactatacataccacagaatgcatagatatttctgtgatggtacttgattatgagaactaaaatgagctatatctaaaaattagtttgtgtgccaagattaaatgaagatgagatatataaaaaaaagctagatttgtagctaatctctcggaaaatatacacgttatttcaaatttctttgaactaatttttgtttgaccaaaggccacccaataggcatcttccattgttgctgtagtgactacactttatttgatcattcgtctttattacgctcttatctaagaacttgttcaacatttctgtgataagatgactaactttgtttgcctcgccccttcaggctcaacacttttcatctcgctggacggggtgagatgaatgttacgcttggtattcctcgtttgaaagaacttctaatgactgcatcggctaaaattagtacaccttttatgaagtgtcctctgcttgaagataagacttggtgagctttatttgttttttactttgaagatggctcatgctagtattctcttaggttgatttatgtaatttacgtgagtctgtacacatgtttcctgcatttctcattgcctgctgaatatgatacggggcaaatagagatcttgatcaaactatacttaaacttttgcaccacactagcatgatataaagggactaattttctgcatatagggatgatgatgaagaagaaatggatgataaattaaagaaggcccgtgatgctgaacgattggctgctaaattaaggacgattgatgatgctgaacgaattgctgctaaattaaggagggttcgtgtagctgacattgtagagagaattgaagtatgcacagttccttttcacaacaataatggttgtgtttcaaccctgtataagttacagttgaaactctacccacaagggctatatccacgtcagtcagaacttacagtagaagagtgccatgaaaccttgagaactgtttttattgatgcaatggatcttgctatcagcaaacatttagatttgctacacaaaattaatgagatccaggcagttaagtcaaatgatatggagagtcaacggtctgatggagtcgaagaatctgaaaatggacctactgatgaagacaatggtgtgagcgatggtgaaaatgaggatgatttgggagctgatgcagaaaaatggaaacggcaagagatagatgagatggagtatgatgatgatgctgaaaaggaagagggttttgatatggatagtgaatctgaagaagataccaaatctaaacctgagagtgaagatcatcaagcaaaattagatgaagagttagaagagtctgaggaaggacatgtgctagattctagcaacaagggggaaaatttaaaagctaagcaagcaacagccagactcgaagatgaaatgaatgaagctgaggatgaaaaggcgcaagtgaccataaagttcaagaaaaacataaaatggactattcattatgaatcaacaggtttaaattttgaggttcactacgctttgcaagagcaacctcatattctgttagcccaggtacttctttatatacagtacaacttacattttgcacctcacattgtaacataggttgaatcatcttaatagttcgccctgtgcatataattatgctttgctttgtactatattgatggcttgtttgaatttcttttccagattgctcagagaacagctaggtctgtttttgtcaaggcctgtaagaatattgatcgatgtgaagtgaataaaccaaagaagatagataataatacgataaatactcccatcactctacaaacagcaggggtgaactttgaagtattccataagttagtggactatctcgatatcaatgaggtcagatccaatgatatacacgctatgttgaacacatatggggtagaggctgcaagggcaaccatcattggggaagtgaagggcgtattcggtgcttatggtatccatgttgacatgaggcatctgaacttgattgcggatttcatgaccttcgacggcggttaccgaccgatgagcaggctagggatgggccagttcagcacctcgccatttggtaagatgacttttgagacggcaaccaagtttattgtggaagcagcttctcatggagagtctgacacactggacggcccttcggcaagcgtctgtctggggaaacctgttaaggtggggacgggttcctttggcttgctgcagaatttttccctggagcaacctgttgcgatgtaagcatacatgtagcatcatcagcctgtttgctttactggattagtccaattttgatggaggctgccatagagcagtaggaatgtgttacatatacggtactttttgctagcaagtgcagcaagttatgtcagttctcagttgtgtttgtgtagcaggaaacgaacatgtgaacactgatactccctttggtagtagtatggacattagtctctgtgtagactgtgtggagtatcaggctggcagcagcagtagcagcatgatcttggtttctttgccattttagatgcatttcagcacccttgttttttctgcctttaaacccaaatccgatagccactttgccgttgctgtctgcatgaggttaagatggcagctgagggggaatatatctaggactccagctgcaatatcttttctataattgagtgtg

SEQ ID NO: 897 - DNA, 7888 bp, Oryza sativa
taaatttgaagtgcaacttgcaccttcttaccaaggaagtactgcttgtccgccgaaatgggaatcttatttttgttcggaaggcaaaccagttagaaattggtgatattgcttatagactattgcaggatggtgatcttgttttggtaaataggccaccttcagttcatcaacattctctgattgccctatctgcaaaacttctgtcaactcagtcagctgtgtcaattaatccactatgttgtgatcctttcaagggagactttgatggggactgtttgcatggatatattcctcaatgtctgcaatcaagaattgagcttgaagaactagttggtttaagtggccaactcttgaatcaacaagatgggcgaagtttggtgtcattaacacatgactctctagctgctgcacatcagttaacaaatgcagatgttttcttggagaaagctgaatttcaacagcttcagatgttatcctcttccatctcattgacaccaatgccatcagtttttaaatctacaaactctcaaggtcctctttggactggtaagcaactgtttggaatgctgctaccttatggtatgaatatcagttttgatcagaagttacacataaaagacagtgaagtgcttacctgctcatcaggatctttttggttacagaataacacatccagccttttctctgtcatgttcaaagagtatggttgtaaggctcttgagttcctttcttccacccaggatgtactatgtgaattcttaaccatgtggggtttaagtgtctccctttcagatctctatctgttctcagaccattactcaaggagaaaactgagtgaggaagttcatctggcattggatgaagcggaagaggcttttcaaatcaagcaaatattgctaaattcagtatctataccaaatctgaagtattatgatggaggtgatgatagatcaaacactgatgaacaatctggttttactcaagtcagtctgccaatcatcagatcttcaatgacatcatttaagagtgtcttcaatgatctgttgaagatggtgcagcagtatgtgagtaaagataattcaatgatgacaatgattaactctggaagtaaaggtagtgttctgaagtttgttcaacagactgcatgtgttggtcttcaactaccagcaagtaaatttccctttagaattccctcacaactatcatgtgtttcctggaatagacataaatctctcaattgtgaaatcactgacggcaccagtgaatgtgtgggaggccaagacatgtatgctgttgttagaaattcttttcttgatggactaaatccgttagaatgtctactgcatgccatatctggcagggcaaatttctttagcgaaaatgctgacgttcctgggactttgacaaggaaactaatgtatcacttgagagatacatacgttgcttatgatgggactgttagaagttcttatgggcagcaaatagtgcggttttcttatgatactgctgatggcatgtacagtgatcatgatcttgaaggtgaacctggggcccctgttggctcttgggctgcttgttccatttcagaagctgcctatggagctttggatcacccagttaacagtttagaggattcccctcttatgaacttgcaggttatattcttctggtttgctctttaatggtcttttgttgtcatttttattcatctttccttttgacaatatttgaactttggcactttgctgtgcaggaagttttgaagtgccacaagggcacaaattctctggatcatactggtttgcttttcctgtcaaagcatctaaggaaatatagatatggttttgagtatgcatcactagaagttaaggatcatctagaacgagtggacttttctgatatggttgacacggtcattattttgttagtatatttaatctgtggctttcttcaccttttaatattgttcattttagtaaaaatttcatgtcttctttcattttcatatttagatatggcggctcagatatgcagaaaacaaaaggaaatccttggatcactcattttcatttaaaccaggtcttgttcttttgaagtaaaatggtcatgatttcatagggacattgggttggtatctaaatgtctgttcaaatttgtatatatgtgtaggaaacaatgaagataaaaaggttaggactggaatttattgtaagagagattattgaccaatacaacaccttaagaaaacagttgaacaatgcgatcccttcagtttctatttcgaacaggtaactgcagaaactatttgtgctatgcatgattatcgtgtccatcaactgcctccctgttttccttacctgaaaaagaagcagcaaagtacagaagtacctgatcttctcctaaatgctcaagttactaattgagcttacactgagaaaaattctgggcatgtgtattatatttatttggcatattgtatggtactacctctgtcccaaaatataacaacttttggctatgaatctggacaagtaattacttggtcaaaagcattaatttataatagtgcatgcttcatttcttttgttaagacataaacctgcatgattcaaaaggggaaaaaggatatgtgcttatatgggtatctattattatattattgaaacagtataaatcagccttgcatgcaaaacaacgtcagcatcaattggatgtatatatgtactattatagtgttgagtgcagaatattattctactctctgactgaacctacctaggcatccattcatgccccgatacagatcaagaaaaattacccactggatcatttggtttttacttgagtaaaaactgagcttttttgcatcccccccaaaaagagcacttttactcactgattcatgttatttttactgatttatggagcaagggcatcttttgagaacattatcctatacctcataaaaaacggttactttgtgaatggctaagggtgggttgtgaagttagcttgtgggtttgaatcctgtttcgcaaattaaattacagtaatttttcgcagatgttttcaattatctgtagtgaaactcttcacttgaagatggaaaataaatctgggaagctagggaaaaacctgggcacgggtaggtggtgtgtgtgagtaaaatcctagtgcaaaaatagtaaaacatatctggaagtggaaagcaaaatccgtgacctaatataaagctattctaaacataggagtacaaatgtacagtgtgctactctgtgtgtgtgtgtgtgtttacatattgaatactgctatatttcaattctgcgaggaactcggctagttattacacatctacccagcaagaataaatcaaaatattaaactttagggtaaaacgaaccggtgataccacaatttgtgaagtggattctagtttgtcggtcatcttacaagttgatcaaacaagtccccaacttgattgctgagtgcaaatcgagtcaaacacacaccacataagctaattacgctgacaatagatgctagcgtagtgtgagactgtgagtgccagcagcatgtgatccacggacccaaaggtatgggtgttatttttgcatactcaaaaagaagtcaaaggaacatggtgctcctctcttctattgaatggtctgttgtcctcccgccactctgcactatacatcaaacactgccttcttgttcaagcaggctgtggattatgtgctgcttacatggcaccctcaggttaggctggtgttggtgttgctgaaagtaaccccccatggcattgttttgaacttgatttgcaagttgcgaccacactaatcaagttgtgtgactagctgatcagtttgtgaaaggagcgactaacttgcattttactctggagtttttttcccccatctagtattttctatttcattaatttattagggtaacttacagaaaataaaataagttcaggataataattctagatacatcagtgctgtttctgtacattgatggggaatcccacataagtaacaacccaaacaaacaatcatacacaagtgttattaatattttacttactgaaattccttcaatagcattgttgtctatatttaaattgcactatctgtttacctccagctattgctgcgctgcctgagtaacatttacgcataaattctttcatctaatatatcaataagtaaatgtgacctgtccatgaagctcaaacaactatatttgttttagcacaaggcatcgcagctgattctagaattatgtgtgcatatacatgtttcatgctgttatgcctgtagctatcctattctctttctagttcccatgggccatgacatatcatttggcattctataccctgcagcaaatgttctgtaggcaatgagtgtgtcaagaatcagacctgttgcgtcactatggtagtacaggtggaaattaactccatgtcgcaattggacgttatcaaggaacgggtgattccaagcatcctggccacactgttgaaaggttattatgttttgatggattttttccccaaaaaatcttctcaatgttctagggaactcctcagtaggatcaaaatccaagtttgtcactaataggtcaatagccatctaactacagaagaaagtgtttcatgcaaatgtactacttgttgtatgctagatataccaagtttatgcatagctctgagttattttaatactctttcaaaggccattcttgttgtaataacttcacatatcattatattattgtttcacaaatatgagaaaaaggtatcataaaatgtataaaggggcttttatgactgattatttggttgatttggttagcaaaagtaagtctagttctaactcgcagaacccattgtccattgatccactcacatgatagaactcaagctattgcgtgatctttttagactgaaaacacattatattgaatgagtagtcaaaacaaaatatatgagttggcttctctgggttcaccatgggggctatgcttttcaaattatagttcatcatacttgctgctggtgcactagtatgcagataaattttgatgtacgctgcttgatttcctctgtttgcaggatttttggaatttaagaatgttaaggtgcaatgtcaagaggataatgaacttgttctgaaagtcggtatgtctgagcattgcaagagtgggaagttctgggctaccctacaaaatgcttgcatcccaataatggagttgattgattgggagcggagccgaccagagagagtatatgataatttctgctcatatggcatagactcagcatggaaattctttgtcgaagtatgatacttgctacccttcattctggcttcactgtttcattcattcctgtgtaaaatggtttcaaagtttaattgtttgtgataaatttctcctgtaggtttataacattttcattttcacttgctttttcagtctttaagatccacaacagatgctattggaaggaatatccatcgacagcacttactggttgtggcagactgcctatctgtgagtgggcagttccatgggctaagcagtcaaggtttaaagcagcaaaggacttggttatcaatctcctctccattttctgaagcatgcttttctgtgagaaatcttagctttcttactgattattaactatgagatttcccttttgaaatgttctgaacatcttctgattttatggcttttcctgcagaggcctgcacacagttttataaatgctgcaaagcgagattcagtggacaatctttctggtactctagatgcaattgcctggggcaaagaaccttgtgcagggtcgtcaggtcctttcaagattctatattctgggaaggtgtgtattgtaacttccctgctgaatcaagcactactcttttagagtaactttaacgtgctcccaaaatgaaaagaaaattgagatcttgatcaatcaccccctatgaatactcacgatgcattatacatgcacaatttaactctttggatagcataaaggtacaatactaaatttctttcctaatgctttgcctacgagcctctaatgggctgcaagctagagaaatttgcattgagtaagtattcactgaaataatttgttttctggttctgaataattgatataaaatgaagtgaagatcttatattatctctatgatgttcatattatttatgctgagctgttgattgatgatattccgttacattaattttgtacagaaattgaatcgcagtgcctgcttctgtgatagatggatgttcagatatttcaaattggctgctaacatttattcttttttgcagtcacatgagacaaaacaaaatgagcacatatatgactttctacataaccctgaagttcaggctcttgaaaagaatgtaatggatacctacagaaaaaggactgaaaaaacttccaagcggagatcagcactcaattctgaaggcaatgctaccatcaatggtggtgccatatcttttaatcagaagtttcttaatgctaaagttggtatatgggagaacatcattgacatgcgcacttccttgcaaaacatgcttcgggagtatgttataccactatccatggaatcgtgactgatagttattttcttttttaaaaaaaaagctttataatccttggtattgatgtcatcttctactttcatgaaggtacacattaaatgaagttgtcacagaacaagataaatcatgcttaatggaggccttgaaatttcatcccagagggtatgacaagattggtgtgggaataagagaaatcaaggtaggtacatagaatgcaattttcctttatggcatagccctcgtcttttctataatcctacaaatatcaattgaaattttcattgatcacaaaccgcattaatattttctctaatggctcaaagaataagaatatttttcttcatgcttatgtatgttatattctcggttttaacatgcaagtgccggtagtgaactgtccaattaacgtggtaggtttgggggttgtgctcatataattcggaattagggtactattattgtaatatttccaagcactgttaacttcttgatgttgaagaaagataatacctcccccccacgctgactgcacaatttatgtcgagcttgctgttagcactgatgaattcctgctttataaccattgctttttttatacgtgatatcaaaagcatcccgcgttatgattattcttcattctagcatgttctgatcaaaacatatgttgtgtgccacatacagatcggagtgaatcctggtcacccgagctcaaggtgcttcattgtactaaggaatgatgatactactgcagacttctcttacaacaagtgtgtccttggtgctgcaaattctatctcacctgaacttggaagttatatagagaacagacgatctaatagagcagttcggccacatcagttgtagggtgagcccgtcaatgctttacgaacaagtatcagaagcaattttcatggataacgatagattggcgaatgttgcttcttggctgcttcggttaacggggatggcagggtcttacactctacagggatgtgtgtcaactcaactcaactcactcgagctacagatggccgacctgagccttagtgtaggtttcatgccttcacttctgtagcacatacatctatagtaacccttaagtttgtttggacaagaggtagtggcacaaagtgcaataggtgtcgtcgttatccttgcatcaattgtatgcggaaatgatccatattctaaatgagaatcacaaaattttggtcgttgaatttaatctagaatgtgatttattcgtgaa

SEQ ID NO: 898 - DNA, 13143 bp, Oryza sativa
aagtcttagtgtttttcaaatttggccgttcttgctgccctgttacagaaaacagagcaatagccatatctccggaacaagcattagtatttttcaaggcttagtataatttgaaaaatactaaggcttgttcttgtcaaatttgtctgttccaaatttggttatcaacataaataacaaaaaagagtgatacaaacccttaatcttataaggcttgttcaggagatattcttgtaacaggattgcgactgcgctatagcaaccgaaggcacaaaaaactgttttgtgctggtttgtaactgcaagagagccaaacaaggccataaacgaaataccagtacaatggtcatcaataaggagcttttagccttactaattggaactattcgttcatatagaagacaaagattataggagagaaacattgttggccggttaacaatgcctcaaaacgactcttggcaccagtaaaataaaaagcactttgccatatatgatgataaagagaatacttgttgatactaagggtgtgttcggaacccagagttcccaattcacccctctctttttccgcgtgcacgtttttcaaactactaaacgatgtgtttttttgcaaaaaagtttttatacaaaagttgcttaaaaaaaccatattgatctatttttgaaaaaaaataataaatacttaattaatcacgcgctaatggactggtctgttttctgtgcggggagtttagttcccaactccccatatccgaacagggctgtgtttgaggagaaggagatagagaagattgggaagatacgcaaaatgaggtgagccattatcgcatgattaattgattattaactattttaaacttgaaaaatggattaatatgattttttaagcagctttctataattttttttttgcaaaacacacaccgtttagtagtttgggaagcgtgcgcgcggaaaacgaaacaaactcacacacaatcacccaggaaagaacacagataaatatattttttaaagatatatacaagatatgagaaaataaattgttgctacggttaaatggttcaacaacgatctttagcatatataaaataaacacttttgttgtataagggtgtaaacgaaagaaaaataccaatttttttaatggttagagtcatgattggcttaggtactgtgagagtctcttgtataactctgtgtgggggctgtatatttaaacatgcctttaactgttgaagattttttttagggaaaaaagggaaaaaaatttttaggggatttttttagggaaaaaggaaaaaaaatattttttaggggaaaaaaaaggtgatgatatgaagaagaatcgaacccgcgactcctctgttacataaaacggaacaagccaacccgtcgatccccaacatacggctaagatacgggaataaaattaattaaacaatgtagatactcgccctacctatttatttcctccaagccgaaaaaagcgaagtcatctagggtcccgcgccgccgccaactctcccccgttcctcccctttccgcgcgagcggcgagccggcgggcggcggctgtcggaggttcgcctcgcctcgcctcctctcccgcgccgccggcgagaaggcccgtaggtgcgttgtgtacggtttcctctccttctccacctcgccctagcctcctctctctctccctctccctcgccctaagcccctacaaaaccccagctccattccccattgctaccgtcacctctccctctccccttcctactctgcctcctccgccaggttttcacgatccgaagcggctccggctcgcgaacggcggcgtcgagcggagcccagtcgggaggggagatggcgcggccggaggagaagctgcggtgcacgaaggagcccttcatcgaggatgtcggcacgcggaggatgtaaggccccgtcggtccggcgtgttttcatcgtcgtcgtcgtcgtcgcgctgcggttgtgtttactgacttttggttttgttttctgattcgatttgaaccaatccggttcagaaagagcatccggttcagcatgttctcggggaacgaggtgcgccaatccgcggaggtgcaggtttggaacagccggatctacaaccatgagatgaagccggtgcccaatggattgctcgacacgcggatggtaaatgcgtgttgcccttcgagtttctcattgattgcagatgtttgagcaaatgtggtttcatttgcttcatcataggaaggcagctgggctatgctttccggatcctgtttcatggttcattgttgttcttttttatacaacatttcatataatttcagggtgcggcaaacaagcttggggagtgcagtacttgccatggttcatttgctgaatgcccgggtcattttggttacttgaagctcgcccttccagtttttaatgttggattctttaactgtattttggatgtattgaagtgcatctgcaaggtatcactgcacgaataagattagatgttttgtctaaatccaccaaatgtgattattcttatacttgttccataatttatttaaagagctgcagcagggttcttcttatggagaaagatcggctagagtttttgaagaaaatgagaaatcccaaagcagatccgctacagaaaagtgctatcatgaaaaaagtgagggacaaatgcaaactatcccgttgcccctggtgtggattcataaatggcaagctactttctgatactcctttttatcctcggctcctcgccacttaaattttccttaggatggcttactaatggtcacctgactgctgtcaacattttacagaacatttctcacttttgcgtttctttggttggtagtacaggtgttgctaaaaagggcagagcagggttgattattcttcatgattgtagcaaaacattggatggaagcacagaagagcttcgggacgcactatcacataagaaagagaaactatctattagtgctgttcgcatgctagaccctgcaattgttctatctcttttcaaaagaatgaccgatgaggtagatcctatttttttgtctttcaagattactattttatgagagtaccacaatttgtattgtacagactacagatttgttcgattagttttatgtatgttttctctcactttgatattatgcactctacaggattgtgagttgctaaacctcggtgataggcctgagaaacttattgtgacagagattgcagtgccacctgtacctatacgtccttctgttttcgtggctggtggaagaatgaggtttgctcttcagttttttagtacctatatgtcaaatggtgattcagcataaccacattttccttttaatgcattgaattgtcttgcttcccacagcaatgaagatagcattaccgtcatattgaagagtattgctaatactaattccatccttaaggagaaccttcaaactggtggtcagttcatgaagtgctttgtaagacactcacagctcttcgtttgtttattttctcccatttttttctcttagtgcagtgcaacttctgtatgtttagaattcctttcggatagtttgctagaaactcagaaatcaccttgtctctgtatcttcatgaaacacacagcttgatagacccataatctagtttagggttaatctcaatttgtctgtatggaacctacaaggcaaaatatttaggaaacttgatgatttacacaagtagaaaatatgaaagccagaaatcatattctaacaggattgattattctgtagtaagtcagattgtgactttcctttgatatgcagaattcatgtgggggctggtgtcttatcagcatgacaggttcaaagtattacagttttgaaaatccgacttaagtgtgacaaaatgcttattcctatttagctaactaaattactaagtcagtaactactgtttcaagagaaaaatgcactcgtctctatgaaggaaaacaaccatttagatcattcaaaattgtgttttttatgactctttcacaagagttcctctggtgctatgctatcaaaatattctgactgtacgatatgcattctaacaatttgatattactttaaatgattacatctacttcttttcaatctttgaaggattgctggcaacaccttcaacttcaagttgttgaatatatcaacagtgacgcaccctctcttcccgagtcacaacatcgaggccttgttcagcgactcaaagggaagacaggccgatttcgtggtaacttgtctggaaaacgtaccgagtacactggaaggactgtcatttctcctgatccaaacttgagaataacagaggtacatggcaatatagaagttttttatgttcacttccttgttgatgtttaacgtcatcattaattaacacttcaggtggctattcccatcctgatggctcgagttttgacttatcctgaaagagtttcatactataacatagagaagctgcgtcagtgtatacggaatggtccacacaaacatccaggggcaaatttcatcatacaacctgatggaacaaagctgtaagtcatatcagtaaatgcactgaaattagttataagttcagcgtatatactcaattatcctacatttttaggcacttaaagtattgcgatagaagaattgctgctcgagatttgaagtatggctgtgtagtcgaaaggcatttagaagatggagacattgtcctcttcaatagacaaccgagcttgcatagaatgtcaattatgtctcacagggtataaattgctcttcattacactgcacccgctacatgaaaatgttacctcatattggtcccttgctctttgtatttaatcacaggctaggattatgccctggagaacactaaggtttaacgagtctgtctgtaacccatataatgctgattttgatggcgatgagatgaatttgcatgttcctcagactgaggaagcccgcactgaagcgcttatgctcatgggggtagcatttgctaactctttctttttacagttgaccatctttttttttttttgatgttctaccactattctgtagctaatattcaaaatcattaatacttttgcaggttcagaacaatttatgtaccccaaagaatggggaaatactggttgcatccacgcaagactttttgacttcctcttttctggttacaagaaaagataacttttatgacaggtcgtcattttctctcttatgttcatatcttggtgatgcaatggaaaacattgatttgccaacacctgctctgattaaggtaaggctttttcataggaacgcactttgcaagtatcagattgaagacatgctatttcttaatgcttcaaccaatgtttgtcattaataggagatattatttgggcatgggggacagcatgccatcacttttatttgacttcgacagtattatcaaactggattactttgtcatataagttttagtaatttttgtagtgaatttcagcattattatgcataacaagaggcagtaccttgtctcttttccagctgcgcctttgtgcatcttagctttctcatcaaattcctgatttctctgtatactgattcagtgattatgttctccttgtacagcctattgagctttggactggtaaacaactcttcagtgtgttagtacgtcctaacgcatgtacaaaggtgtttctgaatcttactgttaaagagaaaatttataagactcctaagggttcaactctggaacctgaagcaatgtgtcccaatgatggttttgtctacttccgaaacagtgaacttctatctgggcaagttgggaaggccactttaggtgagaatcccacccagtactgattcatagctaaaacgactgccaacctgataatcctaagtactcactctgtcccaaaaatataggtacctctctaatctgagctagaaaggcagctatattttgggatggaggagtatgctatattctctttaggagaacattagtttataggcatggactataaacaatagtcctggcatggtttaccctcttatgaatcaccacatacaataaatgttcctttaatcaggtttggaaaatgtattgttcacttgtgctagttagttgtccttgttattttcatcctgcttgttaaatttggaagcaaaccaaaacaatctttaatcttttgtttccaggtaatgggaataaggatggcatgttctccactcttgtaagagattataattctcatgctgcggcaagctgtatgaaccgcttggcaaaatttaggtgagctacaaaattgcgtaatggacccattctttcctaaatattaactaacaaatgctatgcaattatttttttgttctgtctttgttccattaaagaatgcgagagggttaatagaaatcactaataagtcaaacactctgccttctttttattttattttacgtgaatctgccatcttttttatttgtacgcaaaccactttgccatttgacactaattaagtcagggagcttagttggtgtacactcgttcaattttatctctctattattaccattttgctgagtttctcatttgtattgttggtgttagattgttacataatttagtgcacatttttttttctgatttgaattgcattcatcttttcctgcagtgcaagatttatagggaaccatggtttctcaattggtgtggacgatgtccaaccgggagaacatttaaaccaagagaagaaaatgaaaatagatggagggtacaaagattgccatgatcttattgcttcctattccaaaggtgcactccgtttgcagcccggttgcaacgcagcccaaacattggagcaaagtataactcgtgtactgaatgaaatcagagaagaagctggaaaagtatgtttcatccaattttattgtctttctgaatttccttagccagtaagcctgtcaatattttgttaatttaatccattgttgtacttttgcatattctttacagatagaaaaatatttttagccttgcatttcatattattttccagtgagcaaatctttgaattttcctgaaccaaattttgttgcatggatattctcatcatgagtctgatttttagcgtgattttgacttctactggagacccgatgcaattattttgttgactcaaaacaaaattattcaaatttgattttgcactttttttattgaatgcacttaaacttatttatcaggtctgtatgaatacacttcactggaggaacagcccattgatcatgtctcagtgtggatctaaaggttctccaatcaacattagtcagatggttgcatgtgttggccaacaatcagttggagggcgtcgtgccccgaatggcttcatagatcgaactcttccccactttcctataaattcaaagactcctgcagtaagaacatcagtactagaaatatgacttgcttatttgtgtatccatttctggtgctggatatttctagttctgttcaaataagtactcttcaaattttatggggcactatacatagagatagaggctggaaattgaaaatatatgtaatgttttattttaaacacaatatctcttatgttatagaaagttctgaattgacattacttccctttgatgtatatatatgtggtatcctaaatggctaattaattatttatttttcattaaaggatcgtgggattctattggaagttatcatgtagaaaaattggtccttttcagagtggggatttcgttgactcgtagtcctccacctagctttgttagagaaaacatttttttattcaacttgttctgactgcaattttgtttgaattaaaggtcacgaaatcagcacattttggtatattcacatacaaatatgttttgtattccatttccaggccaaaggctttgtcgctaattctttctatactggcttgactgccaccgaattcttcttccatacgatgggtgggcgagaaggtcttgttgatacagcggtatgtctatgtataaaaccatctattgtttgcataagttgatatttgcactctatctgtatttcagcacaaaaatttcttaaatttgctcacatagacttacaccgcagtacatactactcaattgaattaatagtagtacaatgatgatattatgtgagaggaatagtctgaattagctccttgtgcctggcagggataggattaggaaacttagcagctattatagaagagcacatcatcaactagaaacaaatgataagttcattcatcacattcttatagaattaagcccacttctcctttatattttgagcacagcaatgattggggaagatgtttccttgttcgttgtttgggcactaaatcaacttgcttgcataccagagttgaatctggcgtttccgtttgactctgccttttaggctttggtccttgcagttgagtgttttatctcaggcactgtagttcgctgcatgaaaaccttcacagcactatgccagttctatgtagaggtctgttaggtgaactatactggtatcttgtgcattcagctggaccaaggtgcaacccattgggcatttccagcatactcattgtgccttctggcttctcaaaaacatttgggaattgttggaaatttggaatataatttctgcttgtttccttggttgtgaacttgtgatcgtaggttaaaacagctgaaacaggatatatgtcccgcagattaatgaagggattggaagatctctcagttttctatgatcagacggtccgcaatgctagtggtggtattgtacagttcctctatggagatgatggcatggatcctgcaaagatggaagggaaagatggaaagcccttaaatttggatcaattgtttatgaaagtcatggtcagttttaacatgtaaaaacagtttgtttacttgatcaagtgagatgcgcctcgtgtgctaaccattttactgttgtaggccacttgtcctcaaaggggacagaatacattatctccaggtgaaatcttacaaattttaaatgacaagctctctgaacatgatgcctcctctgatgatggttgtagcgaaaagttcaagcaactgttaacgtattttcttgaggatcgtataaaattgctgaagagcacaaggagagcgcttctcctagatgaagatcatgttggagagaggcactccagctttgaagaatccattgctgctaatatttctggtatatctgtgaagcaactacaggtgtgtctattcatatttttcacataccaattcatctctgttttgcgaaaaacctgaaatatcaagcacagtctatttctgatcaattttttggtctcttactaattgcgtggtcatgctaattttctgcagtaaatgttaaactgatttcaagtattatttttattggtttgcttatgcattttatccttgtgtcgtcattctgtaatggttttccttttctccatatggctcaggttttcttggacacatgtttatctcgttaccacttgaagaaaattgaagccggagcatcaattggggcaattggggctcaaagtattggagagcctggaactcagatgacattgaaaactttccattttgcaggagtagctagcatgagtatcctatatactatatggttcgtgaaagtctgcttttaattttaagaattactagcaggtcgttttggcctatttcctataatttatttactttagaggggcattggaatgtagtatctaagataaagcggatgaaattgtcaataatatgcgctaaaagatataagctttcatcaatctgaattgatttgcacaatactacagcatttgatatcttgatgtagagtaatgcatacatgctattcttggacactgctgttcaaatcatctttccttaacaagtaaaaagatgttactcttggtgttcctcgcatcaaggaaattatcaatgctgctaaaaagataagcacacctattatcactgctgagttactttctgagaaggatgtgttgtctgcacgcattgtgaaaggctctatggaaaaggcagtgctgggtgaggtatgttgcccccaaacttgctttcgatgttgataattgtatcctcttgtattttacatcattacacgcacttaaaacttacaagaagtcagtctgctttacatcttcatctatgtttcttaaatacattaaaatcatgacatgcatttaatacacttcaaagatattagccatttgatatttgtctacgcatcaagctagtggcatcatatttaccaggttattcaatttacagaaatgaaaagctctgcccacaatttataaattttatgaaggagagaactcaaatttaggaatttcacggtgttactttgcccttaacttttggatgtatggatggtctttgtgttgagcaggtggctgaagccataaagattgtgttgaaatcaagtcaaccaaacttggttgttaaactcgatatgcaacgtatagaagccctgcacatgggcatctctgctgactctgtgcagctgtcaatattgaatcatccaaaaataaagctaaaatctgaggtatcaacaaagctctttgatacgcctgaccatcagttttttctgttaatattatttattgtacgtcatctttgcagcatgttcgtgttattgataaatccaagttgagaatttatccagctggaatagataagtccaaacttctatatgagttacatcatctcaaatccatgcttccaaaagtgatcgtgaaggttagcatttatcaagatgtgcagtgttagatgtgccattttggctgtctctgaccttcctactaatcaattcagggtattccaactgttgaaagagctgtgatcagcgaaactggtgaagaaaatgacaaaagatacaagttgttggttgaggggtatgagttcatataatcatatcattcacagttttagcagcatgaactaaagttccgtttgtagatttgctgacccttgttagaattttattgacctatttttgtagatcactagagttccagggtcttgtctcttggaatggcttagtttctgacttactccaacttctgcattatttttctagaatattaatcaaatagttctgtaattgcagaacaaatctcttggcagtaatgggtactccaggagttgatgctatgaaaacaaaaagtaaccacatcatggaagtgaaccgaacactcggaattgaagctgcgaggagatctattattgatgaaattcagtatacaatgaaaagtcatgggatgaacattgattcgagacatatgatgcttctggcagatttgatgacatacaaggtacaataattaacacctaccttcattttattatgctatatttttaatctatgttgtgtacccttcaacagtaacttacatactgctggttcttattctccgagcagggtgaaattcttggcattactagatatggtattgcaaaaatgaaaagtagtgtgctgatgctggcttcgtttgagaaaacagcggagcatctctttaatgcatcatacagtggtcgtgaggatcagatagagggagttagtgaatgcattatcatgggtatacccatgcaacttggcactggtattctcaaagtcagacaaaggtacgaatgattagcttgcaccctttgattgtgctatagcatactatgatggcaaacttgtctttcctgagccactgtactacttacatcagacatggcgaaattacagcttcaccggcagtaacattgttagaacttctggatcaaccagacaaacctcacgttttactgataatacccttttttccttgcaggcttgaccatttgcctgaatttaaatatcagcctgatccaatattggcgtgatacaagctagaagcctagaaccagcttaatttgtctgaagctggaattctgtacagatatatagaggggttggatgtataagcatgtataagcatcatatagcagggcagctacggcaactgtaatttgaggcaagtatgcactgctgaggtagcattggggcaaaactcccttttttctgatagtccaccgtatgtttcagcttattttggtttcaatcccccaggtttattctgtttccagagcaggattagtttaaagttcaaacatatactagctaggtgcagtgtgccacagtttgattagaattgggcccgctcattgaacttttctaaagaaggaaaaaatggtccctggtctaatgtcaaaagcttgagcagaacaaagtaaatatcacgtctctcttttggttcttccgtttctcctgtgtcttcagagcgagcgtagctgtcactccatagacaaccgcttatttttatttttttttctgatttcctcctagctctcacctgtcaacaacacatttgatctgctaatgctgctgctgccgtcatgcaccaacaagagaagatcgcctggaaagtaaggaaagagatcaaggagctcatctagaaggtatgttgatcgcttttgttaacttgttactctcactccacgggtcggtcggcgtgtcgtgtgagatcggtgctgcatcctcacctactctcccctccattcctccccgatctgtcaagatctcgcacgacttcgtcgtcgtttcttcctttgtctgaccgacggaatagcatatgcagaatgcaactgcatatgctctgcaaattgctgcgaatgtactacgctcctgaccgattcacatcagggaggaggaaacgagggttggtacgatggatgagagtccggaatatacattttctgattcttctttcgtcagacgccgacatacatgacccgtcagtaaaggaccctggttccttttgtttgacgtaatgacatgtcgccgaaattaagaggagaggatgaggaagaagccatcttgaaaagtgagaaccgatacgaaatgtgcgttttccggagggtaatttggaaccataccattataattttgtaaagtttaagatatgccatcggtatcttaatgacatgtagaacccacataagtcagttggatgcgtctttttccg

SEQ ID NO: 899 - DNA, 8520 bp, Oryza sativa
taaaattaatttctattgattcaacccaatgcgaagtgatttttattagataagaagcgacgaagcatattaatcgatagtaatgattaatttagaatgatggaggttttggtacggcctttgcttaaggggtgatcgaactagcacggaaagaaagtaatcctctgtatacttgtaagtttatccccactaaatatagttattgctatttctcttttctcttattaagccacatcatccgaattatttttagccattggatgatggatttatggttcaaattgtcttttttttcttctctcataacaccatacaatctcaataatttatagactcaaaattcataagtatcaatttgttttagttttaataatcatattgcatcatatttgtatatattatataacttaatttcccgcagcaacgcagcggggtattgatctatttcttatttaaatgtactcgctaggttaaaaaaatatgagcatttctgtacttcctttttttttacggggatggaggtgaaattaaataagacatgatttttactgggattaaggagagaagtgatattaaataagtgatggttttcatggggattaaggaatggtgaaattaaatgagtactgattttcgcagaatttaaagagaggtggaatgaaataagagatgattaattgatatattctaaaataaaattaaaatgccagatggttatattttaggatagaggaaatgaaatattagtaaagtgctcttgataacaaatacaattatacaactttgatgttaaatatttagattatttaaaatataatattggtcccacgtggagtatttacagatttttatactgctttggtaggtaaaactttcagaattgaaaggatggaaattaaacgtcggtaaaaaaaagaagccccacatggagtatttacatttttttactgttttcttctttcaccattgtaattacaacaacaactaaaatacacagtgatgtaggcctcacccttattcacaaagtagatagaacatatggagtaggcaagataccaaagttggatggagagagagagagagtaaaagatgcgtgttgactgttgagtattgagtgagtaaaagagaggcctcctgccttctgagttctgagctttctcaatacttgacacttacactttgggtggctaccggttggttacagttacagaagaggtttgtataacacagtaaaaaccagtagataatacagttcccaaaaaacttcattcctgtgtttgtttggcatctgaggtcgccattgatcgactagcaagctcttgatcttgtccatccataaccatattaaaaaaaaagaaacaaaggtatgttctagggttcttcggttgatatctagttgtttgattctccttttggttggacatgacactgatcatacgaaccatttggtttcagtgattgcatactaacctctgcctccacaggtacagtcgtacagaaatggaaggtcatcctgatccaacatctgctgctactgccatgatccccgaggcctcgatcagacgcatcaacctgagtatcaccagcaacgaggaaattgtaagctgtcaaaccatcatcaccttcacctgccaatggtatttggtatcatattcttttacccattgctgtgactcctgtgtattcggcagctgaaggcgcagccggtgaacgagctcgagaagccgatccccatcacgcatcaaagccagctgctgaacaatccatacttgggcctgcctctgcaagtcggcagctgtcagtcgtgtggcagcaacgccatcgaagaatgcgagggtatgctagtcagtcgcaatctcttttgtgcgatcctgcattggacaataactttcagatttccaaacgggtgcaaatgaaagcaagttttgtgaagttattcactgtttattttgcatggcatgatgtctgaaaatctgtttctggaaaaaaaaaagaaaagatattgcaaagaacagtttcagagacagtgctcactcttcactctgttgtgtacctttgatggaaataaaattcattttttgatgattgattccaaggtcacttcagattcattgagctgcccatgcccatcttccacccgagccatgtcaccgagctgagccagatactcaacttaatatgcctgagatgcctcaagatcaagaacagaaaggtacaactgcaaaaaccatgctcaggcatatcatcagcatatgcgataagccatactatattgtcatcgctaacacatgtttctgcacttaacaactcaaacagaagagcactcttaagggaagcaaattcacttcatgttcacactgtcaggtaatttgcagctgatcatccatttatgtttcttaggggtcaatgttgcttttccctcaactgtgaaaagccaagtaatgcaaacaggcatcattagttcttgaatccatcttattccaggagctcccaccgctgtgcgttgcagaagtcaagaagtccaatggtgcccgtggcttggagttgagagcacctatcaagaaagaactggaagagggattctggagcttccttgatcagtttggcagttgcacgaggggtacctctcattgtcgtcctttgctcccagaagaggtactcttgctcatgttgcgaaagccacccctattggaacaaagcaaagataaatgcataagtttcagaacttacatagagtagctttgcatatagaaattgttgcacacatttatcttactatctgtcccccttcgcattttattcttctgtttgtcaggtccaaaacatcataaagaagatccctgaagaaacaagaaggtggctttctgttaggggatatattcctcaggatggttttatactgagctatctctgcgtcccaccaaactgcctgagggtttccaatgttttggatggaaatacattcagctgttcagtaagttcatcctaatcaaacactatttgattgaagtttagaagttctttttgcctttttcccttctagatgtcattaccactgacctagtgatttatgtcccttctttaatcagggcacatcgacaaacttattaaggaaagcactacgtaagatacagcagattcgtggttcaaggattggttcctcaaacatccaagtggatcaagttgcagatgatcttcaggtcgatgttgccaactacatcaacctcggaggaacaacaaaggtacatgattcattagtaaataaagtgtaggttaccttcttcatcataattgcatcttcataaatttatcatcatcgtatgtctcttgaagggtcacggagatgacacgttcacaagtcaaccaacagcaatgcaatggaagcaaaaaatgaagacattgttcatcagtaagagctcaagcttctcgtcccgtggtgtgattactggtgatccatacattggtctcaatgttgttggggtgcctgaggaagtagcaaagagaatgtcagtagaagaaaaagtcacagaccacaacattgctcaattgcaagacatgatgaataaaggactatgtttgacatatacagatgccaattccatcacgtactcattggatgcagggaaggacaatccgaacaagaaacacaccatactgaaggtcggcgaaattgtcaacagaagggttttcgacggggatattgtcttcctcaacaggccaccaagcactgataagcactcagttgaggccttctatgtccaagtccacaatgatcacaccataaagatcaacccactcatttgtgacccacttggagcagattttgatggtgactgtgtccaaatcttctacccaaggtcgctttcagcaagagctgaagctaaagagctatacactgtggataagcagctggtgagctcccataatgggaaactgaactttcagttcaagaatgatttctcactagctctgaagatcatgtgtggtagggagtattctgagagggaagcaaaccaaattacaaatgcaatgttctcatcagggatgtacccccagaagccactgattggtggaccttactggacctttcctcagattctagagaccactaaatctaatgcaataacactggcagaccatcttgacagagaatctgttggagccttagctactggtaccaccatctcatcgatcctttctacaaagggtccaagggaggccacagaatttctgaatcttctgcagcccttactaatggagtcactgcttattgattgcttcagcataaatttgggagatttcactgtcccaagtccaattctggaagctattcaaaataatccacttgagctaaataagtacagggaaccaattatggatttcataacccattcttctgccataggactgttggttgatcccaaaagtgattccaacatgaacaaagtagtggagcagcttggtttcctggggcctcaactacaacacaacggaagactatacagtagcaggttagtggaggattgcctgtctaagtctctgcacagatgttgcgggagtaccaattgttgcaaccctctagaggaatatggtactgtaaggagctcaatttaccatggactaaacccatatgaggctctacttcattctatatgtgaaagggagaagataatgcgtgcatctaaagggctagtggagcctggcagtcttttcaagaacatgatgtcaagactccgagatgtcacagcatgctatgatggatccataagaacttcgtctggtaacttagttcttcagtttggctcaagggatgcatcaaattgtgtgacaccaggtgaccccgttggtatcttggcagccactgcagttgcaaatgctgcttacaaggcagtgttggctcctaatcagaataatataatttcttgggactcgatgaaggtgagaagctgaccagatcaattcactccaagcctcagttcaattcatatgtagactgtaatttactaattttgactactaaattttgttttactactaaattcatatgttttttttactactaaatgttactgttataggaagtactgcttactagggcaagcactaaagctgatgccaatcaccgaaaggtcattttgtatctgaaccagtgctcttgtgaaaatgaatgcatggagagagcactcacaattcgagcctgcttaaggaggatcaaattagaggattgtaccacagagatatccatcaagtatgtactatcaggctttccaattatttatgcttctgcaatgtaaagatacaagtcctattgattctactttacctggactataaattaaactaaatctacaaaacttatttcatgtgatgcaagcaattaaacagcaactattgatttggcatcctattgaactttttggggaaaaagagcatttcgttgaacttgcccagttcagtccagcattagtttcttagatttcccttttagtagttctacattgtccaaggctcagaattgttgggataatatttcaggtatcaacagcaagcaactcaagcagctcatcatcttgttggccatattcaccttgacaaggtctatcattcagtaactcaaattatatccatgtcatttcataataatcactaagattataagtttctcttgctcttacagaagcaattgaatcagattgaaacaattatggacagtgttcttcacaaatgccaggagacttttaggaataacataaagaagaagggatcgatgcgtgaaatattgaagacagtcactttcatttcaaggtgcttcaaacttctattattttagcaataaagacagtatgaatagagatttactgctcttctgaacttcaggtccagtagtctactaatttaagtcatatgttcagtgctagaccactaagttctttatggcacagttcagactctagtaaatatattatcttccattaggtatttatgcatttgggactaccatccatattttgagtaaaagaatatttttaaggaagtatgactatatttttgttgtaaactaaatcatgtgtttcttctttgcagcacaagtttgtgcgaccaacatacagatgatgataaaaaatttcaggtttcctgcttgcagtttttcctccctggaagcatcactaaaaatatatctgaatctactgaacgagttatcgatttcatgactaatgccattttccctataattttagacactgttataaaaggtaaaaaaaatgcaagaggaacatccagacagttatggtgaaaatgtcctatgcaattatgcttacttacaatcaattctgcaccttctcttcacaggtgatcctcgagttgaggaagccaacctagtaaggattgaaccagaatcaacattttgggtccagagctctggtgcagaacagaaaggcgaggcggcactggaaatcactgtggaagaggctgcggctgctgagagtggcaatgcctggggagtagcaatgaatgcatgtatccctgtgatggatctgattgacaccaccaggtctatgccgtacgatatacagcaagtccgacaggtgtttggcatttcctccgcattcgaaaaagtcacacaggttcagttattcccctttctccttttagctgaaattcaggtaacttctgctgaaacattgctcgtgttgtgctcctttcagtacctttccaagtctgttggaatgattacaaaatcagttctccaagagcacctgacaacagttgcaagtagcatgacctgcacaggcgatttgcatggcttcaacaactctggctacaaggccacatgtcaatctctgaaggttcaggcaccatttatggaggctacactatcagtaagtcatgcactctcatctcttttgaaatcctcacttaaatgagccagaaccaagtcttggtcataattcaaatataacaaaacatgttgcagagatcaatacaatgctttgagaaggcagcagcgaaggcctactccgatcagctgggcaatgttgtatcagcctgctcttggggcaataatgcagaaattggaactggttcagcttttgaaatcctttggaatgacgagaacatggtacatttgacaactttacttgttaacaccactcatatttacagagacttttgaagatcactttaacttcttatctcttttcagtcatcaagcaagagtatccttggtgggtatggtctgtatgacttcttggaagcagtagaaacaacaggagcaactaaagataaggcaattgttcctcataactactgcttatatgatgttgactgcattccagaggataaagtatgtttagaagaaaacaatcagatcacctggacagacaaaccaaaagctgaattcctgatggaatctgagggtaggagggcagggatgcacagcactggccaaaaacatccgaggaagccaaattggcatgaaggaaacaccaagagttccccaaattctactgcagtagaatttactggtcaggtgttccagagaaggcaactgaagaccaagagtaactggaactcagatgcaacacagcaagatgataaaccaagttggtatagttcaaatagcgcgggcacacagaacttcaccattgcaggatcatcccgaccaggtgaatggaacaggaagaataataatcgcggtcaaggtggtggtagagaagtgtggaaatcagagggaccacaccgtggaggcagtagcagtaataggaatcaaggtggtggtagagcagtgtggaaatcagaggcatcacaccgaggcagtggcaataataggaatcgaggtggtggtagagcagtgtggaaatcagaggcatcacgccgtggaggcagtatgaggcaggtagcgagttgtgcttttacaccagtggagcagcagatatttgaacaaatcgaaccaatcacaaagaatgtaaagaggatcatccgtgaatcgaggtatttttctggtccaataaacttgaaaaggcacaagtactaggattcttcatttttcgaccactagtacgttgatagctagatgataagatggaagttaagtgtatgttcaaacaccgcccaggtggttccttctgttgtatcccttacagtccatctctctcaatacttttgcagggacggtattaaacttcctccagatgatgagaagtttattgtcacaaatgttctcatgtaccacccagagaggaagaagaagatagctggcaacggcaactacataacagtaagcaacttgccttcttgaatctttctgcgtcagatgaaccaaaaaatggaaaaccatgaggactcatttgctgcttataggtcgataggcatcaggtattccatggaagtaggtgcttatatgtcatgtcctcagatggatccagaaaagatttctcctacaagaagtgcctggagaactacatcagagctcagtacccagatgctgcagattcattctgcagaaagtacttcaaatga

SEQ ID NO: 900 - DNA, 16253 bp, Oryza sativa
cagaagacgtagttgatgcaaagtagtcgtgccggaggatgctcccccaaaacttgatcacctgcctactcgtgcagatacacaagtggatggagtttcggaggcctgctcgtcccgagcacccgtgcaggcaggtgatgcctcacctgtgcccggctcggcgtgacgcgtgcgcatatggcaatcccaccatcacctcaaccggtcaacatgtgctctctaatagctctctatttaagttgagatatctccacttaaattttcaaggtggtattaattctataacattatttgtgagccaatggaatttattgggaataaattgggcctagcccatttactccaacatcatgtgattaaatcaaaccttacattgaaatatcgagcagagcacactacgagagccgaatcgtgcatgtcagcgagaaaatcgtcttttagataggtgtcaaacacaagtgaatacagacaattttcatcgggctacgtgagaaagaggaagacgtgggtaaggccgagactgtgcacgtgtgtgagtcccactgggtcccacaaaacgatttatacgctgcagagatcaaacataagttttgttcgtttgcatggactgaactaatcaatgcaacactagagatgccctaatcttggacaaagaggtggttggcttatcgtctttttgagttacgacgaagaggtgatgacacaactcatcctcatggtcaatgataatcatcgtcaagccctcatggtgtgtattgttgataagtgagagatcacgagaaagcatagcctagtgcacaataaagcttgttcgggcaagctcgtctcaacattttttagcgtccaaatttatcttggtaatgctagttgagtattgatgcagatacattggttgacttctatttcatcgaattggctcagtttttgagtcccttctatttactatggtcacatgcttctcatgactactcaacatcatcctgcttggtctagccatcaacgacatcgtatttctatcagccacgttggtgagttcgttcgttcattctagctctctgtattttttccatgcaaaaatgatatactgcttgctactccttttgcgtgtcaccttttcttttggcattgtgtaaaggcctgtgttcatttttggcgcttgataatttgcccatttatgacattggttactgccaaaaaccacccaaatcaaagaatggccaaaaatcagctggcttcacccaacagttggtgctacacgtcatcccattcaatgccttccggtcaatccccccatctctctcctcccagctcccaacacgtgacccccggtgacccccacactcactgcgaggtgggtcccacctacgccacgaccagcctatggcccacatgtcagtgacgtggcgtcgaacagccgccggcgcgcgggggtgacctagcctgacctgcacactgaactgcacctgagacctgacctcccaccaccaccatcgtcgcctcgctctcgcactcgcactcgcgctcgtgtgggttcccttctcggcttctccgaggcgagggcttggctgcaggctaaaaccctctccgcccccaccccccgcgcggtggctagggttttagggcgagggtgggaggaggcaggcaggcgcgcgcgcgcgcgcgggtgttcaggtgagggggaggagggctctgatcccgtctccgcaatgtggggggcgctgggttactcgcagaaatggggggaaaggggatgtggttggttgtttgtctgttcatcgtcgcttgttgtggggggtttgggtttccccgagggaagggaagatttgggtcgtgcggagaggcgtgggttattcaattttggtgcactttgatatgcctttttgtttcccaactaaggggttctatctcatgtatgataaatgttcaccggagtaatccgtgtgggtttggggggaagtttgtggtgtgctgggaatctaaacgaatcctgatgattgtgcgaaatgtttttttagttaggggaggggaggggatcctggtgagcatccgcatcctctttctgatgattcatctctcactctaccacctggagtgcttttgtgtggaatttgctcgcgttcgttcgttaaccctagcttctcttctagatctggaagaagctctttctcttaatttcagagccttaaccttgatacaagtaacagtttgtttgtacttttggatcttcccctgttgttgggtgtacttttggtgggtcgtagtaggatgctagagctaagatgaaacagaaggaaatgcagcttcagcggtaggagtaacctaatattagcttagccactttgccctaattaacttgcttggagacaagggcacactctctaagggaatatatttgttagtgcacccattaggaaaaggaaacaaatgattaaaatcaaaagcaagtttgatttggagtggtattttccgagaagccaacaaataattacagcggtttttatcctacgtttgcgaatttgaggttgctgttttctgtttgtttctgctatttcttgttgtttaattggagctaatggtgggttctagcttgttggtattaccggttctttcttttcaattctttttacggacacagccatgtccctttgtctatttcagatagatggaggaggaccagtcagcaattccggttgctgaaggtgccatcaagagcatcaagcttagcctatccactgaggatgagattgtaagttctccttctctgatgctttttaccagcaatgcttgcagaaagagatgcatgcagaagcgacaacttggtcattgtgatccattagagacagtaccgtctgataagggagcatatgattgatgtaactactcttgatgatgagatctagaaaccctccttttctctatcatttatatttgatatcatttgcgaatggacctctagctgagttggttaggtggctctagtagcactcctcaggtcctgggttcgactccttgtgggagcgaatttcaggctggggttgaaaaaaaatcccctcgtttgtcccacgccaaagcataggtctaaggaccagcctattttcacgggttacggtgctgctgtgtaagggtggggcaagggttcgggggttttcttgacctgcctgtgccgctgtgtaaggggggttagggggttttcttgacatgcgtgagaaggtcttaccctccctcccccgtcaggtcaagttttatatttgatatcattcaattagatttacctatgatgcatgatctgtgctattcaatcgcaatgcaaaatttgaatttgtaagattaattttatcaagatgagtgttgctatgagagcttttctttttgacctttacttttgcaatgtaaagatgaatgttgtttgttagttaatactgaaatctgacattttcttttgcatctggaagtgctgatacatgggctttttcgctaactaacggagctgttttacattttgtggatttaaatacttgatgttgcattcttctacttgattcatatgaatttagccttctttttttttgtattttttgtttctcatgaatatggcaaggatatatcctgcacagttcccatttatatttcctactgtaatactatgttttttatttccaacatgactgatacacacctttctgtcctgcagcgtacttattctataaatgactgtcctgtcactcatcctagtcagctcggaaatcccttccttgggttacctttggagacaggaaaatgcgagtcctgtggtgcctcagaaaatggaaaatgcgaaggttctcacatgatgacttctcattagtttttcatgcccaagatattgttctgtagcaactgacaatccacttttctcttctttaaaaccaaaattatctgcttatttagggcatttcgggtacattgagctgcctgtgcctatatatcacccttgccatgtaacggaactgaggcagatattaaatgtggtatgtttgaaatgcctccgcgtcaagaaaggaaaggtacatacaggtcaaagcagctaagtcttaattttctaaatccaattgtcttactttggcttataattaatgtgatcttaccatgtatcaggtcaaacagacagagggaaaggataacacatcagcattgtcatgctactattgtcgggtactttccaaccccaacaattttgtatatcccttctgccttgaagtagacagacataatatttcattgtttgacatgtataagtagtaggaatatggaacatatgcctctcgaagaaccaagtataccagtgttttaagtttaatccactcatacatagtccggatgttacagcttagttggttttaaattgatcaaaatctgcttgggcaaaacatagccaatgttactgacatagctgttgcagtattcactcagtaatcctatccatacatatgctttcacttatatattaagttacggaataagttttatgttgcattcttttgcaataaaaccattgattgcaaagtttttttgtctacacagagaatgagtgacagactagcactgtattcagttttatgtttgttcagtaacatgtcgtcgttgaaaacagtacacaggatcaaagttatgctgtatgatggagtgttattggaacttgtaagatgtggccaacaatcatgacataagcattactatatcatgtttttattagttttttagcgtatggcttttggtatacagctttagttgtttttattagatgctagccttgacactataaacatttacaatccggatgagtggcaactgatgttcatcgccatttacttctttaggatcttccggcattatctttgaaagaaatcaaaacagcagatggtgcatttcgtttagagttgaaaatgcctcctaggaaattcatgacagaaggctcatggaacttccttgacaagtatggatttcaccatggtggaacctcccactgcaggaccttgctcccggaagaggttaatctcatttactttatttttatgacttctgtaagctcctaaatatccaacaacctacatgatcgtctgtcattcctgtatcgtttgctaggctctcaatatattgaagaaaattcctgaagaaacgaagaggaaactagctgctcgtggttacattgctcaatctggatatgtgatgaaatacctccccgtgccaccaaattgtttatacattccagaatttacagatgggcagagcatcatgtcctatgtgagttcttcctcacgtttgttcttcataattttcctgactggttcaattctatgtcatggcttattatacttgcttctcatatcaggacatatcaatatctctgctgaagaaggtgcttcagaaaatagagcagataaaaaagtcaagagctggatccccaaactttgaatcacatgaagttgaatcatgtgatctacagctctctattgcccagtacatacatctaaggggcactacaagggtatgttgcatgatcttaatgtgatagtttatttaccatatttacatgagagcatgttcaggagagtcctgtctcagctagagaattgctccagagagtagctcatctgctcacacacaaattggtcacttgttttgtaatcgtaattgtcaccaagccatgaattaggatcgactagttgtcaactgcatttgcacaggctgtcgacttaagctcatttttacaacaatttcaatactccttatagtaaccaaactaaaaatatgaatttacatttgacttcatattaatataattataatgactgagcacatgcatacaagggattttgattcataaatctctcagaagatagcaacaaatgaccaagcatatccatatgggttgggttgatcttgtgtcgggttgatcctgtgcatgagtatacactgtggatggttatcattgaggatgaacggtctgctattgtgcgtctatgtgcaccctttattagagaaaacagccatgcaaaccatgcatgcattgtcagtgaattcataatttcatattgcataggacgtccgtcatgatcatagacacactaagcaaaactgctcatttccctacattaactatattatcgaactcccttatagctattaaacccgaaactacaacatttctatagtagttggacctgaaaaggttcatgaaattcatcaactattagttcatgttaaagctttcttccataggtttatgttttacaaccgttctctcccagtagttgtgtgcaatcacttatttagtcttgtttcttttgtcccacggtaatgttgtcttgcagggtcctcaagacaacaccaagagatttgcaatcagtactgatccttctgcgttatcaacaaaacaatggctggagaagatgagaacattatttatcagcaaagggtcagggttttcatcacgcagtgtacttactggagatccatatattggagtagatgtgattggactgccttctgaagtggcaaaaagaatcactttcgaagagcaggtaacagacatcaaccttaacaggttgcaagagattgtggataagggattgtgtttgacctacagagatggccaggcaacctatgccatcaccgttggatccaaaggtcacactaccctgaaagtcggacagactatcagtaggagaattgttgatggggatgttgttttccttaaccgtccacccagtacccacaagcattccctccaggcatttcgcgtgtatgtccatgaagaccatacggtcaagatcaatccgctcatatgcgcaccttttgcagcggactttgacggtgattgtgtgcacatctattatccacagtcccttgctgcaaaagctgaagcactggagcttttcagtgtggagaagcagcttaccagttcgcacagtggcaaggtcaatctccagctagttagtgacagtttgcttgctctgaagcatatgtcttccagaacaatgttgagcaaagaagcagctaaccagctggcaatgcttgttacatgttctcttccagatcctgctgtgatcaagtcaaagccgtactggacaatctcgcaaatagtgcaaggtgctctgccaaaagccttaacttctcaaggggacaaacacgtagtcagggacagcactattataaaactggatcttgacaaagaatctgttcagacatcattctcagatttagtgtattccactctttctgttaagggtccaggagaagcactacaatttttgaatgtgctgcagccattattgatggaattgattcttttggatggctttagtgtaagcctccaggacttcaatgttcccaaggttctattggaagaagcacagaagaacattgaaaaacagtctcttatccttgaacaatcaagatttgcagaaaatcaggttgttgaaatgcgtgttgataataatttgaaggacatcaaacagcaaatttcagattttgttgtgaaacgctctcatcttggacttctgattgatccaaagagtgactcttcagtgtctaaagttgtccagcagcttggttttgtgggtttacaactttaccgtgaggggaagttctactcacgtcgtctggtggaggattgctactacacttttgtgaacaagcacccagctgtcagagaagaacattctccagaggcatatggtcttgtacggagttcatattttcatggccttaatccgtatgaggagctggtgcatgctatttcgacaagagaagctattgttcgctcctctagggggttgacggagcctggaacactatttaagaatctaatggcgttactgcgggatgtcgtcatatgctatgatgggacagtaagaaatgtctgcagcaagtctatcatacaacttaactacacggaggatgatgccttggacttccctagtgcaataggtcctggcgaaccagttggtgtcttggctgcgactgctatctccaaccctgcatacaaggctgtcttggatgcatctcagagtaacaatacttcatgggagcggatgaaggtaataacattaaattattttatgcattggtaaaaggtaatattgtatgcatgcatgataagtttggtatattcctttaacctaacaggaaatacttcagacaacaagtcgctacaaaaacgatatgaaagaccgaaaagttatcctatttctgaatgattgctcttgtgccaagaagttttgcaaggaaaaggctgctattgcagttcagggctgcctaaggagaattacgttagaagattgtgctactgacatctgcattgagtaagtatccataattaatgctgtcaattatattggtatataaattaatgctgtcaattactggggtatgtagttatattcgcttgctttgcttttagtgaaatcaatgaaggactttatttcttttgtggttgttttattgtagttccctggatttcttataccaaagtctaaaactcaagtttccttttcctttttggtccttcagaatactttccatttttgaaatgtgaaagttttgcggatatagaatgtagatagttggcaaatgttcaatatctgtccaatgaactgaaaattatgtggatctagaaagtaacttagtgttaacttatctgtttgcacaaacagtgtgtttgactgggttaggtcttatcatatttagggatggaaactgggctgcacccgctgggtttcagcaccccgtaccacccccgcaatgcaagatattgcccgtccccatccccatccccgcacacgggtcagtcaagtttccccctgtccccatccctgcaccaggtatgggtcacccggtgggtccccacactcggtaacaggaacaagagagtagcaagctacaagccagcaacatgacagcacaacagcaacaaagccaggaacgaaccaacaaaactagttagccaaacacaaatgcctgaacaaccaaacatcaaacagatcatatccaactatccatacttaaacaccaacagcgtcaaagtatgaggtcatagattggcagtggcagcggcgcgttagtcgcgacagtgacgtggtgtgtccttgaagcttcacagtggcgcagcctagaggttgcccttctggttgcccaggtggcttcgtgcagtcgctctcgctccttctggttgccctgccgattggatctgagagagtggaggggaggagtggaaggaagagtggatgtggactgtgctaaggtttcagtactttatatatgcacctctgatttgggccttctaaatgcttttttttttttactttttgggctgtggtcttaaagggatttgcaccttcctgattgacttggggccccatggggattcgggggccgggggcctgcagaacgtccccgctcccagcccacccgatgggtgaacaatttggcctaaaacagccccatggagggtgatttcctcccatttacagcccataatagagttattccccgccggttatcatgtccgggtccccattgccatccctaatagattcatattttatctgtttaatgctgagaacccggtatctcttttccatggatctgcacatcagtgttcattgtccactaactagtcatggacttggttcattgatgttaaacttcaatcatttatatactcttgaaattgtccatcattatgcaactggaactgccataaaacaacttagaaattggtcacgacagtacccagataaatgcaagttttgatcattctcaaaaatggaaattgagataaaagtctccttgtcgcatattgttggcttttagtattcattatcatttgagcagaacaccttaaatataacattcacgttgtcaggtaccagaagcaaataggtttagatggaacttcagaagcagccccagcacttgttggccatattcatcttgacagggtattatgatatattcttatgttggtgaatacttgcatgcaaacagttgtttttattatgccctgataatatatgtacatctttctttcaggcacatttagaaaggatcaacattagcactgaagatattcttcagaaatgccaagaagtttctgggaaatatgggaagaagaaaggacatctcagtaacctgtttaaaaatattacattctctacttggtaactatctattctctactatattgcttgagatctcacgtttgaagaataaattgcacgcactgctgttttgtttatgtggttgtgtcctgccattagttgctatggttgttggcggttttatagttttggtagaagagggttgtcatcttgtagattgctagggttattcaagtgctgcattgctctttaatcagatgttcaatatctaatatttcaacatcatgatgatgtgaaatcctacttatgatatgtgattgtcgctcgctgtatcaaatgataagttagttaacctcaactacaaccatatgctgtacctggcttgcaagtttcatctccattgaagtagtagaaatgagccataagaaagaggtaaggggatctttatttgcttcctagttccaagattgttcagttttgattttctttttcatgttgtttatagcaaagtattggtagcttggcatagcaatggagccatcgtctaggcagagaatattgatgcattgtttatttcaaatcacaattcctggcaatattctacttaagttcattttcagttaatcatttttagcattaattattatctgtttactgtgagacgatattatattatttaatcgtactcaagttttcacccttactcttggcagcgattgtttattcacacagaagctggttgatggaaagctacctaagcttccgtgtttgcaattctttgtttctgataacatgatagtatctgaatcagtggagagagcagtcagtgtgttagctgattctctatgtggagtgcttttgaatacaatcataaaaggtactgtaagttgtacataatatgcttctgttggaatttcattttcaatacaatttattatttaggttcagttgaaaatcctttattcacatcttgccatgttttttaaggggtggggggggggggtccaaaaagccaaagaattatgattgatccatttttagcccttaaaaaacaattatcttccttcacgctcatgtctttcataatacttttctttttttcccccaaaaaagttaccactattttcagaaccataactgttattgtgttgcaaacctagttcatgatggggtaaaccattcattggaggggttcaaacaatgatggcttgtggttgaatggcactaggtggagtgcactgactgagggatggatttagagtagctggttaagggaaagatcatctgattgtatagagagatgtggctctgtttgaggcaataggatgtcatggcctggcataactaaaggataacctgctaacaaaggatgggactataatgaacaaattggtaccctttagtgctaaagctgctgcctgctggctccacagctgtaacagattaagacattctctgttaatgtttggtagttaactgattctattggttaaattattgttataaaattaatgttctcctgtcctgtcacaaaaaaaaaagtgttgatgtgttaaccaaataagggtagtacttttagctcaacaatttccttgaattgagaatgttgctctgcaggtgatcctcgaattcaagaggctaaaattgtttgggttggatcggatgcaacatcttgggttaaaaacacacagaaggcatcaaagggtgagccagcagtagaaattattgttgaagaagaggaagctttacatattggtgatgcctggagaacaacaatggatgcctgcataccggttctgaacctcattgatatacggagatcaatcccttatggtattcaacaagtgcgagaacttcttggcatctcatgtgcttttgatcaagttgtgcaggtttgtcaccttaccctttttgtttgtaagtttgggaggtatttcatttcaaatctgctgtttgcaggtcacgctgcagatctttccaatctttttaatggattatttgaccacttgcatttacaagaacttactaaggaaaatttataaatatatgaacttagtatttcatgatagctctatggctacctctgcttcacaaactactgtgtttccgtggaaatagctgtttgacaatgttgatctaggtgtgttggggaactatctatggtttacgcgtgaatgcgataattgcatttttttttccatgtctgaccaagattttaatgttaatagagaatgttgactggtggaacattcggttttgtttttaatgggcaagtttggtccatttcaattgagttgtatttgatttctacgatgaactcttttgtacatcatgtttgtgcttatggatttgtccaatgcattttataaatttttatcttgcatctcatttcaatagattattttatatgtgctgaattgtgcagcggctttcaacaactgtaaggatggtcgctaaagatgttctcaaagatcatctggtacttgtggcaaatagcatgacatttactggaaacctgaatggatttaacaatgctggttacaaggccaccttccgttccttaaaagttcaagtacctttcacagagtccacattgattgtaagcttatctctgagatcaattggtttgttttttatcatcacatacattttattgatttggcccttttattttgtagacccctatgaaatgctttgagaaggctgcagagaaatgtcattcggattcattgggatgtgttgtttcatcatgttcttggggcaagcatgctgcaagtggtactggatcatcttttcagattctgtggaatgaaagtcaggtaagctggttttttctgcccactggagcttattgattatataagaagtggggcttcactctatttaattggggctaatctgcttaaagatctttgcacggtgtgaccaatcaaatgaattagcgttttagtgaaaaagtagctctgcttattgttgtaattgatttttttcagctgaaaagcaataaggagtatggtgatggcctgtatgattacttggcattggtgcgtactgacgaggaaaaggcaagatacacattctttgatgatgtggactaccttgcagaagagaacgaggcagatgtgtgcttatctcctgaattggatgggaccattggtcaaccgatcttcgatgataatttggaagagcaagatgttcagaataacagctcgtgggataatggcacaacaacaaatgcaagctgggaacagaatggtagtgctggaaatgattctgataaatggggaggttggaatgatgcagctgcaggagctgacacgggagtcacaaaaccagcaaaccaagggaattcgtgttgggatgtgcctgcgacagtggaaaagagttcctctgattggggaggctggggcactgaaaaggcgaaggagaaggagaaaatatctgaagagccagctcaacatgatgcttggtctgtccagggccctaaaagggcaacagatggaggagccagctggaagaagcagtctagcactcagaatgatgggaactcctggaaagagaacaagggaagaggatcaaatggaggttcctgggagaaagataatgcgcaaaagggatcatggggcaggggcaatgatgaagctgaaaataataatgatgtgcaaaacaaatcttgggagactgtggctgcagatgctcatgcttctacagagaagtcctggggcaatgttactgcatctccatcggataatgcatggagtgctgctccggtttcccaagggaatggaagttcagatacaaagcaatctgattcttgggatggctggaagtctgctggagttgacaaagcaattaacaaagacaaggaatccttgggcaatgtgcctgcatctccatcatttagtgcgtggaatgcttctccagtttcccaagggaatgaacgttcagatgcaaagcaatctgattcttgggatggctggaagtctgctggagttgacaaagcaattaacaaagacaaggaatccttgggcaatgtgcctgcatctccatcatttagtgcgtggaatgctgctccagtttcccaagggaatgaacgtttagatgcaaagcaatctgattcttgggatggctggaagtctgctggagttgatgattcagttaaagacaaggaatcctggggtaatgtgcctgcatccccatcagatagtgcgtggaatgctgctccagtttcccaagggaatgaaagttcagatgcaaagcaatctgattcttgggatggttggaagtctgctggagttgatgcttcaactaacaaagacaaggaatcctggggcaatgtgcctgcatctccatcagatagtgcatggaatgctgctccagtttcccaaggggatgatgtctggaattctgctgaagccaatgagtcacgtaataaggactggaaatcagatggatggggtgccagaggtggcaattggaggggccaaagaaacaatcctggtaggcccccaaggaaacctgatggcaggggtctgcctaggagacctgatgagagggggccaccaaggcgacactttgacctaacagctgaggaggaaaagattctaggagaaattgaacccactgtgctgagcatcagaaagattttccgtgaatcaatgtaagttacttcatgattatttgttaattttgtgtgattcatgatttacagttatatgcttttaagtttctgaatagaggaggcttggcttttatatgaaagtatgctaggtccgacatttaattgatttgtactgtcttaagctttttaactttattgttgacttaaaattttgcagtgatagcataaaactttctccggaagacgaaaaattcatcaaagagaatgttcttgaacaccaccctgagaaacaatcaaaggtgtctggtgaaatcgatcacataatggtatggttctcttgttacttttgggttgacctgttgtgcaattgcccgatacgctataatgaaatatagcattcgtttggcttatggtgtgcaatggcctcatttaatttgacaggttgacaagcaccaagtgttccaggatagtcggtgcttgtttgtggtgtcttcagatggaactcggtcagatttctcctatttaaaatgcatggagaattttgtgaggaagacctaccctgagcatggggactcattctgcaagaagtatttcaagaggcgccgtgaccaaccaccagcagctgatggaggcacagcaccaggcactccagctggggctacacagtctactgcagttgatacccaggagggcacttcacagcagacccaaccagatatcgcaaccgctccagctgcaactcaacaagagactcttcaagacactccagctcctccagcagacgatggattgctcgggaagggacctagcccgtctgactgatgctcagggtgcgcttagagctgccaacatcctgcttgtgctctaatcctgccactctttttttcctacttggcctgacattgcctagtgactagacagatggtgactttgtgtagtagagaagggttagcagtctttaggtctcactcttccagacgaactctgtaaattctggatgttagtgagctgcatcccgtagcttaaactcgtttttaccctctcttttttttttatcttttttgtctttccagtatggttatttggttagtccaatgcaagccgattctgcgaggccgtgccgaatctgatgattttgttgttctgcaaggcacagagctctcgctggtgctgtttcattttggatgctgttacagggttttgtaaagacactgaaactaccatgcgaatcagcaaaagatggattccctgctgtgaacaagcaggtggccttgcatgaattcattcatcaaacatgaggtcttgctggtgacgccacaaatttggtttgatgtgtttgcactgagctggaccaatctgttcttgaaatttcttcaggttggtacagaaaataggtaatattgtattctgtcatttcattaccaagaccagtggtgtgaacaagctggaggcattgcttaaatgcatccgtcaaccgtatgattgtttcagca

SEQ ID NO: 901 - DNA, 10861 bp, Oryza sativa
tttctagagacattaaattgcaccacaaacatatgaagccagtccaaaaaagaagaatagaatagtttccttccttttgtcaagctttgaactcaagatcacttgaacatatcatttttatcttcaatgcactaaccaactcaactccatgtcattacttgcatgttggtgcaattagttacttatatttagtcctttagtacacattatcattctaaaaagtgtctctatatagtttaaaatgtctcaagaaaatgcctttacatatcaggcacattttacagtgccgaaagaatgtctctacaagatagaatctaataaactaagctgaaaatgtctctagagtaaaagttttctaagcaattcttaaagtgcctttataaagtgtctctacactgtaaaacttttgatcttagaagcaatttgcaaaacgtctctacaaaagtgcctctatatgaggtttttgttgtagtgaaaacatcatttcacaagagttataaacgtctgaccatcaccattggatatagactggacaatagaggagaccctagtcaccggtcagggtcactcccacggaccaactggtccttggatcgaagcttttcgcggactctgttgtccaacaccttacatggtctatcaaaagttttgttttttatggcatgtggttttccctcaaggctacattaactgcatcgtacttggagtatagcatctacgcttagcttaagtcaatctcccctatctctttctacgctctctctctcctataactcaaaacaaattctacgcgtcagctctaaagatcacttcatttattgcttttgtacatacgcattttataaaatatccttccgcatggttgtcgggtcaaaagacatccttcaacatagccttcaggaccacaaccctcacgcactatattaccaaatgcgtataatagaaatggtaacacgaagctacagaactgtcttgggtggctctatgcacaaccatttcccccattccgtttccaacctctattaccatacctacccaaaccattttccacacaagagatgtatgtgtacccatcatgccatcaccgtcggatgcagatcggacggcggaggaccctcccaaaaaagtgacagcacagtcaaaaacggcaaaaagtaaagagtagaaaccgaagagggcaagccaggtcaaaacccccctcaaatcggaaacctacaaagcctacacctacacagcctagccttcttgtcctccactaccactgtgcagcttccttcctccgccataaagcagaggagagagagcctcacgtgagaggcctcctcggtctcgccgcgctccccccaaaaccccccattttgccatcatcgcctcgtcgccgccgccatccgccgccgtcgtcgccgtcgtcgccggcgacgagtaggtgggactccctttcgtccatgttccaaagatgtttgtgtttgtgtgggcgggttttgtggtgggttgggtgcaatgtgggatgagaagggtgcgtgtctcccttcccctgtttcttgatcgctccgccgccgggtttgttcgccgttgggcgagtggtcagaggatgaggaggagaaaagaaaaggaaataccaaaaaggaaaaaaccctcttttttttttgtttgtgacgcacaaatctgttgcggcgagtgggttttgtttggttttggcacgagcttgcttgctctgtttttcttttattatttccgttttgttgtttatcagattgcgattgttgatgctgggttgcgtgtgtgatgatgatgatggaagtggggggtgattgggcggtttttgatggtggttttcaaccaaaaaaaggaaagaaaaggagagattttttgttgctgtgattttggttttgggaatggtgcgttttgatcatggattgctgactttgtttagaccaaaataagaccatcttttggagatgattgcgatgttgttgtgggtgatgtgaggggtgggtcgggaggggatcatcgtgggatcttcattttgtgacgagcaacaggttcgctcgatgttgtcggggtttgttcagagaggagcagagatagtggtctaataggttaagaaaggttgatttctttttgtgccattgctgggataggaatgtttaggtaaaatggttctctcttgactgttgtgcagaaaggccccgggtcttctgtctagcaccacaagatgtatgttagcggttagccgacccgggttcgagtctcaccctccctttaataaatttcaatatgagagcccctcctctcatactatgcgagttatgatcctgtaatcatgttactgtcataatgtgcgtgttatgatcctgtaatcatgttattgtgcgtgcgccttttcgaggagtcgcttgcggcttctgattcaaggattacatgatgcttttctaaatatattcatttttttttgttcttagttgttaaaaggaacacacttctttttttttgttaacacagggagaagctgtctggtggttagcgatggaagatcctgaaattactggtcagcagtcaccaaatgccacaagtattgtgacggatctcatggatttggatgacattattgttgagggcaatgaggtacagtttgctatggatgtggatttgagagcaataccatctctgaaagatggagggcacacagacccactggtacaaatcccaggtgacatgtctcatatggatgtggatttgagagtgataccatctctgaaagatggagggcatgcagacccaccagtacaagtcccagttgacaagaggattgcaagcctagagaagctctgtaaagaagcatcaagatcatttttcagggaaactaggctagttagccatcagataaactcctacaatgattttgtctctcatgggctccaaaagatgtttgattctctcgatgaagttactgtcgagcctgactatgatccttcaaagaaagtaggcccctggaggcacgcgaccatcaagtttggtcgagtggagcttgaggagccggtgttttgggtcgacaactgtgatcttgatgtggaaacactcaaactgaagcctaaacatgctcgcctccagaagatgacatactcttcaaagatgaaagtagaaatgactgttcaggttgcacctttgacacccctcatactgtgttcagcacgaaataactgcactatgcacaagaaaaaaaaattaaatgcaagaccgaatcatgaacaattttcataactagcagcaaaattagtgagtttgagcaactcttgacttcatgtccacctgttaagtttgttgtcacatgaaagttggcactgtagccataggttttatgtttttcctacaccgtgagtgaaaaaagtttgtgtaactctccattacatattgtgatcacactgttacctagcaaattatcaacgaaattggtatgtttgatcctaaattgtactgtttattcctctcaagcagtagttatgagttaaattaactctcttgtatatatttattaatctatagtactgaattcttgtattgtcatttttctattaaatttcacaccatctgattaattaatatttttgctgtatcaggtctattcactccacaaaagcgacaaagctaaaactggcgaggacccatatatacaaagaaaagatataatgaaagagactaaatgggtcactattggcaagttacctgtcatggtgaagtcaaatttgtgctggctgcataaacttcaggaaagcgaatgcgagtatgattttggtggatattttcttatcaagggaatggaaaaggtattgcttcacatgatctaacaatgcccaacccacccagctagatccaacgatcggaaacaatttgataccgtgaggtaccggtacctcgaggtactttttgttggaccggagtaaatctcataatatatacatggcgtattttactgttgatcaatggataagattttttactggtcttaccttccaagggtctggtacatgctcttagtgcaattaatgcaccgagaaaatttttattaccattctttcattttccccatcctgatgcagcaaagtttccttttctaaacgctaagagccgatgtaagacgttgttaagcttaacatcgatgtttctctccccccccctcttccatgtcagcaaatttaccttgttaaccaccctaagagcctgctattaattattgttgtacatgcccagaggtaagtggagcaccctaatttccttttcatgaaaagtggagcacccaaaaagagcttgtacggcaggatacatttaaaacaacaggcagaacatattcacacataatagtctcacaagatagactagcttggtactgccaaatctgcaatacatatgagtctggaaagatctgaactcagatgaagttagttagatctagcttaacttgtaatgcatattataagaatttgaccatagtgcaattctggttttaaatattagatttgttttgcttcttagttgtgcattgcaacattttaatatgaacctattttagtaattcactttggaattatactttgtagtcttgtcaaaggaattttcagctgcagagttttgcactgcccatcaaaatttaccctcttctggatcactttaattcttaaagttattaccctatgtcggcgcatacaacgtttgatgccatctctgggttatttaaaactcacgtttttattacttccaaccatgtaggtattcgttgctgaagagcagagatgcctctccaggatttggatcaatgacagccccacctgggaggcttgttaccaacggtctcaaatccgacgagaaaagatctctataaaacctgttcagtctaatgatggtttcagaaaagtcattaacctgtactttttgggtgcaactataccaatctggataatgttttttgcactaggtgtatcatcagacaaagaagcttttgatattattgacatacaagaatgtgatgcttccatggccaacataatatcagctactataactgaatctcatgagcagtgcgaaggctttcagagagaagggagagccagtgaatatattgataagttgatcaggaatacaaagtttccaccaaaaggatcctttgatgagtatattggtaggcatatgtttcctgatgttagtgggaataggagcaaagcactcttcttgggatacatggtgagatgtcttctattggcttcctctggcaatcggaagagtgataatagggatgatttccgcaacaagaggctggatttggcatgtgaattgctccagagagagctatgggtacatattatgcatgcccagaaacgtatggtcaaggtcatgcagagacatttgagtggtgatggtgacctacaacctcttgagtgttatgtccatgcatcaattgttaccaatggtctcaaccgtgccttctccactggttcctggtgccatccatttaataaaagagagaggtgttcagggattgttgcaacccttaggagaacaaatcctcttcaaatgatgtctgacatgaggaagacacgacaatgggttgcatatgctggaaaggctggagatgctagatatccgtaagtacctttcgacatagaatcattcattcctgttataatttatttttttgttttcaatatcctaatgcaaactgacttaccaaatcctttcctaggaatccatcatattggggaaagctatgtttcttgtccactcctgatggtgaaaagtgtggatttgtgaaaaatcttgccattactgctatcgttagttgtttggcaagggagccctcggttgacgcacttgtttcttgtgggatgaagaaactggatgaactgcttctacaagagatcagcgggaaagacagaatcttcttgaatggaaacttggttggagtttgtgcagactcagtcgagtttgttttgcacttaaggagcatgagacgcaggaagcaaattgatgcacaggtttctttcttttccagattctgctacactggaacggatttttttttttactttgaagcattgtgtactaatccatgattatgctttgctttcatttatgatgattgaaaatttcctgctaagctattatgctcaattcaaccttgaagcatctctgtgagagattttacatatcatgattgtttgtgctctccataattctgatattgttctgctgttatgggtggctagggatcgtatgggatatgagtgatgggtgggtggccgtggcttaggtaatttggttgatcggcgccccaggatgggcacttcggagaagaaggtgagaaaacagagaaacagatgatgaggagtagattaatcttgcttacttaattcctgagtttaagtgcctcttataggcttacaaaccaaaactaacaattgcaaatagaaaggaactaatcctaacagactccctaacaaactcactaaatatctgattactgttcccgtccggcacgggagaggatcacggcgctgatccggctgttgcgcccttgccgctgtcgatcacatccgtggcgccatccggccttcgcctcctttgatagacaattccgaccatgacatctgcacacttaaacaaggtgcctttaaaagcagtccatgattggcataatctgtctcataatcatttcttggggtatggttttcgcattgtcaccactgatttatttttccagaaatcctaatggaccgcttttgtgtcattcttgtttgagtttatgactttatgcttttgccaaaaaaaaaagaataatcctacaatgtttggtaaaggaaaagggaattgtattcttgcttgttaatatgaactttccattccaataaaatactgttctcatacttcatttccactatgtaatcctttttaagttacttagtaaaattaactaatctgagccaagaagtatatttgatgaatgccatagttggcccatatcttgttgtaagcatgacagcatatttatcacgttagagtactatgtttccatttcttctgtgaaatatgcaacagtatgttaatacaactagatagtactgacaatgtattttggttttaactttgattaggtggagatcaaaagggacaagcaaaacaaagaagttcgtatattttccgatccaggaaggattctaagacctcttcttattgtcgaaaatctacgaaacatcatgaatcgaaagaatggatcatactccttccaggaacttatggatcaaaatataattgagctgattggtgttgaagaagaggaggatatccggtgtgcttatggaattaggcatctctttgcaggggacgaagaaaagaatttctcattctatactcattgtgaacttgacccttctttcttgctaggattgagttgcagtatcattccctttgccaaccatgatactgctaagagaattctaatgcaagctgaaaagatatcgcaacaggctattggctactccactacgaatcctctctttagagttgatacacattcccatcagctctattatccacagagacctctgttcaaaactgtagctgctgattgtcttggtaagagagactatacatctggaagcaaacatgactttgccagaccagagtatttcaatggccaaaatgcaatagtctcaatcagtgtccatcagggatttaaccaagaggattctttggtattgaatagggcctctttagagcgtggcatgtttcgaacacaacattttaagagctataaagcactgatagaaaacaaagagatcaccaaacgattaaaacacaaggaaaatatcaattttggaaaaactcctagcaagaaaggcctggttgacagtttagatattgatggcttaccatatattggagcaagtcttcagagtaatgacattatcattggaaaggtctcagactctggtgaagatcatagcatcaagctgctacatactgaaaaaggaatagtggagaaggttgttctttcagctactgatgatgggacaaattctgcgtttgttactctaagacaggtgaatatgcaatctttacaaaattaatctgcactaaccatttataaatttgcaagatagtggagttctctatgacacactattggaatagttgaatggccaactgattttttctacactaatcgacattctattagagttcattgtgtccataccataacacatcaatcattttcatcttctcatgtctactctgccataacacccaagtgatgaacattagtactgttattccccgtgttccaaaagatctacttgtaaatctgataactgatgaacacttgttaaagttagtaaattttttgatctgattacctctgcagactcgctcgccacgcattggagacaagtttgccagcatgcatggccagaaaggagtcattggcttcttggattcccaggagaacttcccttttactcaccaaggcatagttcctgacattgtgatcaatccccatggctttccaactcgtcagactcccggccaacttcttgaagctgcactaggcaaaggaatcgccctcggcggtgccacccggtatgcgacaccgttcacaagtccatctgtggaagtgatcacagagcagctgcacaagtaagcaattcattctgcccaaaatgatcagtaaatttgattggtttctcttcatgaaagtagaagaactagaaatgttccaaatgttgttgcattttaatccaggccaggttctcaaacaataaatttgattaatttctctccattaaaaagtagacagaactagaaatgtgcaaaattttgttgcattttgatcgggttctcaaacaaggaacttgattgatttctcttcatgaaagtagacggaactggaaatatgtgaaattttattgcattttgatcaaaatcgggttctcaaataatgaacttgagtgatttctcttcataaaagtagagagaactagaagtgttttaatttttgttctattttaatgaacttgaccccattttctttatgaaattagtcagaatgaactagcaaaatgaatgagattcaactgaaaacgtggggaaaagagttgtagtttttttgtcagggctgctcaaaatgatcaataaaattgactgatttctcttcatgaaagtagatagaacttgaaatgttccaaattttgttgcattttgatcagctctgggttctcaaattatgaactcggttgagttctcttaatgaaagtatgttccaattttcgttccattttgatgaacttaactgaattccctttaagaaactagctagagtgaagtaatcaaatgtaagaaatataactgaaaatgtggtgaaaaaacttggattttattttgtcagggctggatttccaaggtggagataaactagaaatgttaaattttgttccatcttgattactgctggattctcaaatgatgaacttgattgaattattgtttctaactgaaaatatgtgaaattgaactgaacttcatgaaactagtactagattgaactactgaattatgtcaaatataactgaagatatggggaaaacaatggatctttttgttggacagggctggattctcaataacttgattgatttctcttcatgaaaatagatagaactagaaacgttatgaattttattccatcttgatctgagccagattcccaaacaatcaactttcaccgaaatatcttcatgaaactacaatagtaatcagatgcacgaaacttaactgaaaatatggggaacaaaatttctctctctctctctctctctcttggacagggctggattctcaataacttgattgttttctcttcatgaaagtagatagaactagaaacattacaatttttatcccctcttactcttagccagattcccaaacaaacaactttcaccgaattctcttcatgaaactacaacagtaaccagatgcaactgaaaatgtgatgaaaaactttggaattcttgtttctttgaacagggctgggttctccaggtggggaggggagagcgtgatcaacggccgcaccggcgagcgtgcggcgtcgccggtgttcaccggaccgacgttctaccagcggctccaccacatggccgaggacaaggtcaagttccggaacaccggcccggtgcacccgctgacgcggcagccggtggaggaccgccgccggtacggcggcgtcaagttcggcgagatggagcgcgactgcctcctcgcccacggcgccgccgccaacctccacgagcgcctcttcctcctcagcgacgtgtcgcgcctccacgtctgccgccgatgccagcgcgccgccgtcgtcgtgtcgcccgccgtcgccgccgacggcggcggcggccggaaggtgagggggccgtactgcaggttctgcaggtcggcggaggaggtggtgagggtgagcgtgccttatggcgccaagatcctctaccaggagctcttctccatgggcatctgcctcaagttcgacaccgagctcatctagagtagactctcagctttggacgggaaacatcatgatttattcttttaaaaatgggatttttatcattttttaagaacatttttaaggacattttagtctggtgaggagagttgacaatttactccattcattttatattataagacgctttggatttgtcgtaataagtctcttgaatgtcattaaaacctgtattgggatattatccaattggggcaattgtgttcttacccctactttcatatctaattgtgattttacccctcttttcta

SEQ ID NO: 902 - DNA, 10569 bp, Oryza sativa
cttggagctggaggcaatcttgacgatccgaaggactgaattttgctgaaaatgttaaagttgcagctatttttatgctgtcatttatgatttctgcatctagaatctataagatttcagatcaccattgcactatgctgtcaagcatgactgcttgatcgaaactgaattctgaattatgtggcttaggccttgtataaagtattttgtcattcatatggcacttacatacacaaagagcagaatacctgaagagctgtttgattgaaattgtatccttctgtacagttgggatgttctctcgttacttctctttgttcttccggttcctgaaactttttgcctgatacagagttttctggtgccaaatgtatttgcaaagttgctatgctacctttggcacaatagtagagcttgtgggtggtcattgtcacattctgggtttacattttaacgaaaaccgatcaaaaccgcaaaaatttgaggtttcgtaggataaaagtagactccgaatgaaatttcaaatggctttcgtaattcaaaattgaaagagtgaaaatcgaccaaaaataattaaaattcgttgaaagaatgtcatactgctgcgatcaggatccgcggggatgacaatgggtcgggtcggacacgggtagagcaaaaccatgcctgtcccgatgcccgatgtgggttagtagacaaaactccgtgccattatgggcataggtatatcggcggtacccaatagatctcacatgaacaataactcaaaagttgtaatttaacgaagagaaataaaatcaataatttaccaaattattagttatcaacaataatttgaattactcagaacttattatcacttatcatcacaaattaaccaagagaaaggggtataagaattaagatattgatctaaattagctaatacatatgtatcgggtccggcacgggttacccatgggtaaaaaatataacccagttgttacccacgacgtctttggatcttggacggacgtgtccacaggtaagaaatcacaccgacactcgtgcccatcgaattgagtatccgatacccggacctgtgagtaaaattgccgttatccgccgcttaatcggaaaggtgacgtcactatgtttaagtgatgggaggggaatgagcttctacctggagtgggtcccacgctccaaccatcgcccccggttttcttcaccctccctgaccgagccctccctccaccctctccggccgctccctctcgccggcgacagatcgagcgtccacggcggcggcggcgcgacggcagaactcgggaacggcggctccgtcgccggcagcacctttgcgcactcgatcagacggccgatcgttgaaaaacaaatgataaactggtcggaccggtttggcccggttttcataaaaaaaccgcctggtcctctctctccagccaccactgaacatgctaccccacataaaacccctcacagaccatccccttctccgccagaacccttctcccccctcttcactctccccggaagcatcgctcgcacgcatcggacgccggaatccccgcctccggcgactagggtttcgccctccggcgacgcccctcctctccaccaggtacattccccctcccgtgtgacgggggctctggtgaggagccccgtccaacatccgcccccctcccctcaatcccctcctcctccccccatttatttctcgcgggttgagagctccgtgtgctccggcgaggtggctcttccacgagggtcgtttacaccctgtcgcgagtgggttttcgatgggatgggaggaggagtagggtaggggagcatgcacgttttcatctgggtggctgggtgggtggattgcctaggtcggctcggtcggcgcggagtaggggaggagcaggggagaagccggagcacgtctcgtagatcgagattccggggtaggaggttgaggctgcggcggggggtcggaggcagagatcttcgaacgattttgttcctgatggtcatctccctcgccgctttattaagactggcgtatgttggtatctttctggcaaacctaaccttgttgggttgctgaggccgctctactgcaatggcgtctatcagtaattaatccaaatctgtctttctgggatggaagggtgtgccaaatcgtccacttttttgtggatttattagtgatttgtttattcgaactcttgatgctgccagtacctttagttcctgtcatgtgatgattgagagctatggtgtaaattgtctgacatattttgtgccaggatgagtgatggcctttaattctgttatttagcggagtagtacatattgagataattcttttttcgcttatacagttctgttaaacaaattaagggtacagctactctgatttgttcctttgctagttttgtgtcacctagtgaatcttaggctgaatgcttcttttactgatgtgctgagtttgaaatacctatccttttaagaaaacactgtatgcgggcgagtgtatgtgcacacattgcgcgtgagtttacgtgtaccccatgcacgtaaattcaaggataaattccttttatatgactgaaagttaatccatttccttatttggcactcattctctcagtgccatgtgggtctagggcccacatgtcagtgagccatgagacatcaatggcaatcaatggactctgtagaattttcagtggaaaaaggggatggccacaaagttcaaggatttctatttctagtgcttcaggggtgaacatgccaatgttcatgggtgttcgggtaaatactcacatgtttaggaaacagcgtgcatcaatccacaaggctctgctctgttggttaccaggcgtacacatctgtactgcaggttctgggtttgattcttggtttccagtcattcctattctttttttttgggggtggggccgcgcgggggaggggggtgacatcttttttcttcttgtttttttgttaggatttcaatagtttatttcatcctcgtattagtgctattgtgctaagtctcaatatggtatctctactatgaaaaatatttaatttaatttttccattaatataatgatactagttatatgtttttattaaaccttgaatacccaacctgcacattctgcttctgccactgcttgaatgtttgctatctagttagatggtttttgtgattgtactgcactgtttgctaggctattccctcgaagttatggaagagccatcaaaggacaatgggcaatcatcctgtgttgttgatcctgagctggaacctatgatgctggatgatgctagagagggagtatcccatacattggatgatgcaaatgggcattcttctatggatgttgacagaggatgccattctatggacaccacgagatcatctctgggtgatgatggtaaaggaaagcgcgactcatatgcccaaattccagtcgacatgagtattccaagcctagaaaagttctgcaaagaagcatcaaggtccttctttgatgagattggtctgatcagccatcagataaattcttataacgagtttgtctcacatgggctccaggaactttttgattctctgggggaagtgactgtggagcctagttatgatccttcaaatagaggaccaggtggctggagacatgctatcatcaagtttggaagagtgcaactagaagaaccagtattttggtctcatggatgtgatattgatgaacaatcgctcaaactgaagccaaggcatgctcgcctacagaatatgacatattcttccaaaatgaaagtggaagttcatttccaggtcagggttcttattgttattttctacactaaatatttacttttatgccataatttgttgaatgccatgagcacaaacggtataagcaatgcaaaaaaaaggtagctgtaaatgcttatatgtgctcagcataattcctttttctactttttgagcgctgtgtacaacacacaatcaattcctgttctcctacgcttagcttgtaaaagtgtgaacatcacgtgacaatttgtccatccaccgaacatcacctgaagaatatagaataaaatagtccacttataagcgtataacatgaaatggagcagtcaaggatcagatgggtgattagtgtttcttgagctgctccacagtcagcagcatgcgctgttgaataatgtatggtactgtttcagtcatgcctgatcctattatcttaattgaactattatgccaatatatttgcctgttcctagtattattgtgcgctgatttgtctccctgatgcaaaacaaagctatgacgtgttggtgttccttagttttctttggtgttactataatctggtttactgaaatgttcttaaccgtgtcaggtttactctatggagaagagtgacaaggctaaaacagggaatgataaatttggttacaagcgaaacattattaatgaaacatattatataaatattggccgccttccagttatggttatgtcaaatttatgttggctccacaaactcaaggaaagtgattgccaatttgattctggtggatactttttgatcaagggaatggagaaggtaatactgtatattcatgtttctccttgccttatcattcagtgattatgtattgtgcctggtctccattctttcattatcatgtgttcaagcgtttatttttgtatgctaggatgaactgcaaggttgtggggggaaattatatagtagaaacctctgcctaaatggaaagttggaaactcctactcaaaaagtaaaaaaaaaagagagaggaaaaactcacatgtagatatggtaattgttatccatgcaaaatatcaacatcaaacccaacatagtttgtgagatatgaaactggcaaataatgaaggaaaagtacttgtcctgattttttttttctttttcttcgctattgtcaatttcatatctcatagatagtcaaaatttgatcttgagatttcgtatggttgcctaatatgacctttcctttatgtgagtttctctccctttttgaaatttttggataacctcgtggtttcctccaaagtttggaggaaaaccactactttataggaaaccaccaagtcatccaaagtagtggttttcactacagattttcctccaaattagttctgtagaatcatttcattttttttttgtttggcgttttagtatagtgtgtggacagctgaccatagccctaattattcgtagtgatctgttggagagtgattctcaatgtttaaaccctctgctggaaagaaagtttttgtaccatatatggcgtttttattttatatcactatgtttcatactatataaattttaaatgctgcaggtattcattgcgcaagagcaaaaatgtctgaccaggatttgggttgaggaccgtccttgctggatggtctctttcttgtctccaatcagaagaaggcgcatatatataaaactaattgattctgcaaataatgaagatgccagtggggggaagatcatttccatctcctttttgtatgcaaatatgccaatatggttgatgttttttgcactaggcatatcatcagataaggatatctttgatgttataaatatggaagactgtgatgcttgtgttatcaacacaattaccgcaactattaaagaatcagatgaattgtgtgaaggcttccgtaaatcagataaagcccggcagtatgttgacgaattgattaagaattcaaaatttcctcctgcagagccatttgatgattatattgctaaatacctcttccccagcataagtgggaaccggaacaaagcacttttcttaggttacatggtcaaatgccttttaatggctttcactgggaagcgcaaatgtgacaacaaggatgatttccggaacaagaggttggacctagctggtgaattgcttggaagagaactccgtgcgcatattaggcatgcagagagactcatggttaaggccttgcagagagatttaaatagtgagcgtgagttacaagaatttgatcattatctggatgcttcaattattaccaatggtctaaaccgtgccttctctactggttcttggtgccatccttacaaaagaaatgaaagatgcgcaggaattgttgcgacactaaggagaacaaatccgcttcagatgatctcggacttgaggaaaactcgccaacgagttgcttatgctgggaaagccggtgatgcaagatatccgtaagtatcttcttatgtttcatgcctatcttgtactatgatgtaaactgacttgaagaaaaaaatacttacagaaatccatcctactggggaaaattgtgttttatgtccactcctgatggtgaaaactgtggacttgtgaaaaatctagctgttacagctactgttagctccagagtagcaccgccattgattgacaggttcatttcttgtggaatgaataagctgcatgagattcctacagaggaggttcctagaatggataaaatcttcctgaatggggattgggtggggtcctgtagtgacccggcttcatttgtcttgcgtttaaggtgcatgagacgcagtggtctgatagatccacaggtttgctctcatttcccatggcaagaagttttctgttggaaccttttttgagcattatgtcaatgattggtgtgctagtcccatagtcttcatcatgcctagttaggaagagtccctaattttgtttcataacctttttggaaaggtcaaactcaaatctgaatgcttagtaagtcattgacctgtattatcttacttctattcagcttgaataatgttgctttgaacgttatatttaggtaatcctgatttggactctatttaagttatgtattctatctggatgcatacacactgggatattggttcctgcatattttttccccttctgtgtagtatgtgctaccccctccgttgaataaataaagtgtatattgtgtctccaacataacaacttgacaatagttttataacctgatgtaacaaaaggaaggaatatatggaaacatctatcaagacagataatgatatatttttatacagttttatgtgtttacttcctctgtcccaaaatatagcaacctaggactctgtctagatatgttgttctaggtggtgtcccatctagtcgttctatgttgctatattctgggacagagggagtaatatatattaatggcctctagatcccaagtaagttacattctggaacagagacataacgagggatactttacatgttgccactaatagtgtatctttttttaatgatccatttgattaggttgagataaaacgggacaagcaccaaagggaagttcgggtgttttctgatgcaggtcgaatcctcagaccgcttcttgtggttgaaaatctcaataaaattaggagaccgaagggcagttcatattcttttcagtggttaatgcaacaagaaataattgagtttattggcgttgaagaagaggaagatatacgaagtgcctggggcatcaggaacctatttgagagtgaagaagaggctcccatggtaaaaatgaataaagcagaggatgtcttcaatgttaagaggaagatcggaggggaggtttcaggttatacgcactgtgagctggatctttcttttctgctaggattaagttgtggtattatcccttttgcgaaccacaattttgctcggagggttctttaccaatctgaaaaacattcacagcaagctattggatactctacaacaaatccgcacatcagagttgataccctttcccatcaactttactatcctcagagaccccttttcaaaacagtgatagctgactgcattggtagatcagaatatacttttgggagaaaggatgactttgccagaccagagtatttcaatggccaaaatgcaatagtggcagtgaatgttcatcaggggtttaatcaagaagattccctggttatgaatagggcttctcttgagcggggtatgtttaggactgagcacttcaggaactataaggctgaagtagagaacaaaggtgggccaggtggcaacaaacgactaaaaatgaaggataagattgacttcggtaaaatgcaaagcaagagaggacgtgttgacaatcttgacgatgatggattaccatatgtcggtgcaagtcttcagagtggtgacattgtcattggaaaggtctcagaatctggtgaagatcatagtattaagctgaagcatactgaaaagggtatggtgcagagggtattactttcagctaatgatgaggggaagaactttgcagttgttactctaagacaggtaatgatattgtttttattaaacatgtatcttctatccagcatattcatgatcctgacattggttgccagttgccactatattcatattatagtactcaacaatagaatgctgtcccttttgaaaatgtgcaatcaaacttttggactttccgagtgatgacataaaagagagattgtgtatatggtaaaaccattactagatctatcatgtacaacactttcattcaattatgccactaacatttagtaaattctaatagctaccagcattttcatagaaattggtttcagagtgcaattgtgcaatgtccaaactggcatatttgtggggagatcaagttatcgaatattggagtatcataatcattgccatacaggatgcttgcatgacttacttgatctggcagtccagatcctgcttatttccttattatttaatttcactgctaaacatgatttagtaattgcattgtcaactaggtgtcacctagtcgttgttacatgactacatgagtcacccaagactagtgacttggcaatcttattctatcatatgttttttctaatattttaggctgtaatatgatatttacattcactgagttctggtggccaaattaagttttgttaatatgatatttacattcactgagttcaggttcgatcaccttgccttggagataaattttccagcatgcatggccagaaaggtgtcgttggttttctagaatctcaggagaatttcccatttacttaccaaggaatagtaccagatattgtgataaatccacatgcatttcctacccgtcaaactccaggccagcttcttgaagctgctttggggaaaggaattgccctcggtggtacaatgagatatgctacaccattcacaacagcatcgtttgatgtgatcacagaccaattacacaagtaagtgtttcttctctaatggatgaattggtttctttcctaaattcactaaccaacctcttcacgcacattggtacaatagatgaaatgatttcggaggggcattatcgctcaaatctgtttgtttaactatgtggttacacacaaactgatattgtttgagctttcttgtaaatcttgttcgttattactgcaaagtgcacattgagcaaaaaaagacaaaaaacagtgcagttttacaagtgcgcaattcagcatcacttattcttgatatgttgatcaatcaggtcaatgtgtgcatgtcaccttaagtggcataaacaattgtttcagaaaatgtcttgtagtgaaacattactacaaactgatgtctcgttccatttcagggctggattttcaagatggggagctgaaagtgttctcaatggccggactggtgaaaggatgcactcattgattttcatgggtcctactttttaccagaggctgatacacatggcagaagataaggtcaagttcaggaacacggggccagtgcaccccctaacacggcaacctgttgctgacaggaagaggtttgggggagtgaagtttggagaaatggagcgtgactgcctcctcgcccatggtgcagcagccaacctccatgagcggctcttcatgcttagtgacttctcgcagatgcacgtctgccagacgtgcgaacgtgtggcgaatgttatcatgaggcctgtcccaggaggaaagaagatccgggggccatactgtgggttctgccgctcttctgaaaacatagtaaggatcaatgtgccctacggcgcaaagctgctctatcaagagctattcagcatggggatctgccttagatttgagacggaagtctgctagaactccacatctactatcgactcaccatgtatatatatcctcgttgtcccttggagattctgttatgggcattagtgttgtagccacatgacttctcttccggttggacgatggcatagctaggaggggtgaatctgaagtcaggtgaaacctttcttttgctatttatttgggtgaagactcaattcccatcacctgcctttgatgtcctgtgaccaaccgatggcatagttagggatggggtgaatcagaggtcaactgaaaacccttttgctatagttcgatgtttcaccttggcactgtactatgcatatttggatgaaaactcatttcccatctcctgcttttgctgttctgtgatgaa

SEQ ID NO: 903 - DNA, 7231 bp, Oryza sativa
cttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcatatggtgaacctgtgtcggctttcgaaatgccttgtcatgaaagccttaaggtctctagtcgtggccgttctgcacgggctggatgatccgggttagtaatgtcgtgtgggaaaagtgtaccccctctgcagaggttattaaaacttttcgaacagccgtgcccacggtcatgggcggatgtgaggtgattcctatcgtagtttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccgtgtcgtttgagaagcactcccttagttgtttcagaaaagagtttaaataaaatcaatcgtaaaaacaacagcctttctttgaagcctgcattaaacacttgtttcccatggcttgctgagtactcctgtactcacccttgctctatataaataattccccccagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgctgcccagcatgactgtactcctactctataataaagagacctctgttgttgtgatattccgtcttcctgtgataccagcactgtttcctgggactggtatcggttaacaggttaatttggagcatcacgggctagttccgctcgggactagttcggggcgtgacactaatgctacactgtatcatatgctttccacacacaaatatttactcgcaagtcgtgcgtatttggaatttagatttttcaaaagaaagttcaaaccatttgcatacttgagatacaaaactcaaaacgaaaattgagatcgagttgtagagtttgacatatatatattataaaattcgacaaagatcaatgatcctctgggcttttcacgtgcaggcgcccccggttccggaatttctgccacgccgctttcgactgacaccgtgacacgaacccacaaaagccgtcagcgtcacaaaccccacttttttcaggtgcatcgccgcaaaaaccccaaccgggctgtgacctcgccggagtccccaaacctcccataccgctatgccgacggcggcggcggcggccacggcgtcgctgcgggtatccaacatcccgccatcggccgtcgccgcggagctgctcgccttcttcgactccgccgtcgccgtcgccggcggcgcgttcgcctgcgagatcgcggcggcccaccgcgggtggctcagccggggccacggcaccgtccagttcggctccgccgcggcggccgctgccgccgcgggcctcgcctcctccggccgcctcccccgcttcctcggcgccctcctctccgtctccccttcccccgtcgacctcctcccgcgcgcgtccgacctctccctccgcgcggccggcgcgggcctcgtggtgggcgaccgcgtcgccgagcgcgtgttcgaggccgccgacgcgtgggacggcgtgcgcgccgaggtcatcccggggaagcggcgggtggacctgtacctggagcacgattcccagaggtacaagctcgaggtgctcttcgaggacatgaaggattgcctcgggtgcaccctggacgggatgggcgccatcttgctgcaggtgagctgccgaccgtattgctctttgtagtactatatgctattgatacactagtcactactagtcagacgttgctgtggcagagtgttgacaacaagtgttctgtgaggcaaaagatggcatgaagataatacgttgatgtgcattttttttcccgtatgtgtcaccttgattttgcgctcagtagtaaggccgcaatagtagattagtagttcatatgatgtgcttgaagtcatggttcaatctacagctgttactccctctgggctgataatacttgtcgttttggataagggtgaggtcaaactttagaatctttgattatgaattatttttaaaatatttgtctttcaaatatggtgactacatgtataaattagtcttaaaaagtactttaataatatcatatatttgttaacacttttatacatattataatagaaaataatggtcaaaattgttttttggagaccgtgcccttgtccaaaacgacaagtattatcaacccggagggagtagttctcaacttttttcaaagattatgttgatttagatcttactcgttttattaaatgtgacctagctacccaaatgatcgcaagagcttttttacaatataagatttagttaatttttacttctttacgcttacaaaatcatgaaacttttatttacttgacatatttgagtagattttacaaatggtggagtaaaacaatctaaaaaaagagtagcattcctatgccaaacaacattaccattagcggctaaattgttgtactataacctcttggactacgatttcagatgcaccattctttcctttttgtatacaatttttatctgacaaatatactgtttacttctaatttttgtttcagctcaattatgcaccaagaatacacactgcaatttctgggcctgcagttaattcaaggtttatggatgaccgctttcatgcatgcaaggaggatgctaaattttcctgggtcagggcacttgattttacacccaattattcttttgggaggtgctctactcttgtccttaaactgggtaaaagtgcattggtgtctgatattctcaaaagtttacctttctcaggaaatttaggggaattgactatgaattcaatggatggtgttggtgcctcctccaatgtggttccccttgttcattgtccgagggactattcagtgccttatgaagttctgtttcgtctgaactctctcatgcatatggggaagatagtcgccaagcatgttaatgccgatctgtttaaagcccttcaagaactaccggttgatgtctcaaggagaatttttgagaaaatgcacaaattagagtctacctgctacgggcctttacaatttatccaacaggaggcttatagcatgaagagaagccataatgttttgctctccaatgaaggtgaaggtgaaggtgaaagaaaattgatgaagtgttatagagttaacataactccctccaaaatattctgctttggacctgaagaagaggttacaaattatgtggttaagcatcattctgcatatgcttctgactttgtgagagttacttttgttgatgaagattggagtaagctttcttctaatgcaatctcagctagaattgaacaaggtttcttttctaagcctttcaaaactggtctatattatcggattctctccattctaaaaaaaggattttccattggtccaaagaactttgaatttttggccttctcagcaagtcaacttcggggaaattctgtttggatgtttgcttctaatgcttccttgaatgctggaggtataagaagatggatgggccactttgagaatatccgttcagtttctaaatgtgcagctagaatgggtcagctgttcagctcctccaggcaaacatttgaagtcttacgatgggatgtggaagtgattccagatattgagatcacaactgatggctccaaatacatattttctgatggtattgggaagatatctttgagatttgccaagcgagttgcacaccacgttggattagatcctactaaccttccttcagcttttcaaataaggtatggtggctacaaaggagtcattgccattgatcctatgtcctctattgatctttctctgcgtcctagtatgaagaaatttgagtctgagagcaggatgttgaacattacaagttggagcaagtctcagccatgctatgtgaatcgtgaaattatttctcttctctcaacattgggtataagggatgaaatttttgttgcaatgcaacaagatgagatgcgtgaaacagaagaaatgctaaccaacaaagaagttgctttgtcagtcctagggaaacttggtggttctgaaacaaagacagcagtgaagatgttgctgcaaggttatgagcctagttcagagccttacctgtcaatgattcttaaggcccatcaggagaataggcttactgacattagaactagatgtaaaatacatgttccaaaaggccgtgttcttattggttgtttggatgaaacaggtgtattagaatatggtcaggtttacattcgaattacaaagaacagcaaagaacaaaaggacagtaatcaatcatatttttataatgatgacgggaaaacagccacagttgttggaaaagttgcaatcacaaaaaatccgtgtctccatcctggtgatatccgagtacttgaagccatctatgaccctgatttggtgggcatggttgattgtcttgtcttccctcaaagaggagaaaggtttgtgatactgaaactgaatttatctcttaccttaatgttttttaaagtttgtattgctttgcccatggcttcaatggaaggaaaggagtccatcacttctctattgaattgaatcaccacgttgtccagcattatcttccttgctaggttccttttttattgtcaaccttatgaatgaatgctgccaatgatttgcttgtatttgatgttgatcaggcctcatccaaacgaatgctcggggggagatttggacggcgacctctattttattacttgggatgacaaacttattccagagaaagttgatacacctatggactacacagcaacaaggccgcgcataatggatcatgttgttacactcgaggtaatgcctgactaattgttccttttcccctttttgctaggctgttgtttctcatttactgaaggatttctttttgttctttactaattcaatcttgatagttgcaaaatgtcaccaattatggactgtagcattatagtcatatatatgggcctgaggcaccttttaaaaatgtatgcttgcggttaagggcatgaataaatgcattaggacaatatgtgcatatgttccatgaaacatgtgatgctaataaggttatgcaaaccagaaagtacaagcttggagtgagtttctaactcaactagtcaactcactcaggatggtttaacaattaacagaaaaactggtggtcattgatctaaaagtaatatatctacgtgaacaccaatcattgaaaagttttgaataatttcaaacaagtatgcactgaccatacacatttaacaatagtatttagaaattttgagagctttattcagaaaagaaaacagcatccccaaaaaaaagaaaaggaaacagcaaatacttgcttctgtgaaaaaagaaaggcctctggaacataaatggcaaatcttattgagtttatgagtatagacttttcaaagttgcctcatgggtgaacaaatgcatatctcctctcaaccatggtgttatactcacctgagtgaaatgttttttaaaaaaatgtctgtaactgcaggaaattcagaagcactttgttgattacatgataaatgactcgcttggtgccatctcaactgcccacttgattcacgcggaccgttcgccactgaaagctcggagtcccgagtgcctccagctggcaactctgcattccatggcagttgacttcgccaagacgggagctccagctgaaatgccgcgaacattgaggccgagggagtaccccgacttcatggaacggtgggagaagccgatgtacatctccaatggtgttcttggcaagctctaccgatcagcgatgggtcacatggagaaatcaggagattcaggagctctctcatcatcctcagcacaaccaagccccacatacgatcctgacctcgaggtccctggctctgacgaattcctgcaagctgcagaggagtactacgagctgtacgaggagaaactgaccacgctgatgaactactaccgtgcggagctcgaggacgagatcctgacgggcaacatccggaacaagatgctgtacctgaagagggacaacaagaggtacttcgagatgaaggaccggatcgtcgccgccgtcgacgccctgcacagggaggcgaggggctggctgctgagctccaggaaggaagaggacgcgtcgcggatggcgtcggcgtggtaccgcgtgacgtaccacccagaccgccgccgcgggaagcggttctggagcttcccgtggatcgcctgcgacaacctgctggcgatcaaggcgtcgagccagctcaggcggcggcggcagaaggacgatgactccaccgcggtggtgcagatggactgcagcgcctgatgtggcagaggattctctgactttgagtgactgacatgtgggcctgctggataagggatccatgggtcagtgacaagttagagggaaataaattagaggttctctgacgcgccgtcctaagtgaactttcaactgcacagttcattgctgtgcgcctgtgcctgtacgctgtacaaatctggttcgactaatcttagctgagctgaacagcagagctccggctcgcaacttggaagaggaaagagtttgatgatgaacacctacgtagagtaaaagttcctcttcctaataaaagagtcttagtgctgatctaccggtaaggtggaggcttccatttcttgttttctgcgaaggaaagaaacttagggtgtgtttagttcacacaaaaattgaaagtttaattgaaagtgaacgatgtaacgaaaaagttggaagttcatgtgtgtaggaaagttttaatgtgatgaaaaggttactccctccgtcccataacataagggattttgagtttttgtttgca

SEQ ID NO: 904 - DNA, 6779 bp, Oryza sativa
ataacatatatatgtataaatacatatatattatgcatgtacatatgtattgaaacatatataaatataatacaatatatatatatatatatatatatatatatatatatatatatatatatatatacatatatatgtattgaaacatatatatgcatggtttaaatatatatatataaaccatgcagcaacagggccatgcaaaaaaaaaaaggtcagctcgatctttagtcccggttggtaacaccaaccgggagtaaagatggcttagccggccacgtggctagtcccggttatttcaccccggactaaagatagcgatctttagtctcggattggtagtcccggtttggaaatcgggactaaagggaggttacgaaccgggactacaaacgctttctccaccagtgatataaatagatgttatagcattgccaaaattttgataaagtaatattctaaaatttagaagttgtttggttgtactcatattttagacttcatttagaagtcccttatctcaagtttattttccatgcgcacactttctgaaccgctaacggcatatttttttttaaaaaaaagttataaaatgattgttttaaaaaaccatattactctttttttattattttagataatacttaattaatcttgtattaatccgctgtttcgttttatgtgcaatggttcctaacacctgagagcgggtataatagcagactataagccagctgcaaacatattttaagtagataaatgaggagagagaatggcagcgggctacagatttgtagccagctgcagcatggactccaagacgcagtgtgtctatgacaggtgggaccaggtattaatagtgtagtatgtaactattctaagctattagattagctatagatgaattggagttagtagttggctatcctattgaacttgctctgatggcaaacacgtacggcttgccaaaatttccacaatctcagaaccaaacagaagaagagtggagtatctatcagcatttacgttgatatttcttttggcttggtaaaagataggagtactgtagtacaaaacaagcggccccttcagcttccaaccttgcaattaaacatcagatgtcttcagtgattcctcctgaaaaagagatctcttcagtgcttctcaccatctttcttgctccatgcattaactcccttctcatcctcctgatgctaaacaattaaactaatcactcatcactcttcttaataaataagaacttttttttaaaaaaaattgcaaacaaaaaacttcctctcttttcaaataatgatataccaatcttaatttgacaaaaatacaacatcctttaaaagctttttactcccggtgataaacataaccgtacaattataactaaaataataataatttaaacacgcaattaaatcgtctctactctccagtactgcactaaacactgacatgtggggccagacacacagttcgcacccgtcctcttcgttggtgtcccctcgcttaaacccctccgaaatttatttactcatcaaaaatttaataaccgaatccgattgatcttcccctctctctctctctctcactcctcccagctcccacccaaccacccaagccatgcgatcgccgcgcggcggggcggccgcgcagccgtcggggcggcgcggcgacacgacggcggcggcggcgggcgatctggtgacgacgcaggtcagccttggcggcttcgacgccggcgtcgccgcgggggacctcgccgacttcctggagcacgaggtcggcctggtctggcgctgccgcgtcaagacctcctggacgccgccggactcctacccggacttcgccctccccaccgcccccgcctccgcctcggccgcggccgcgccgccgcggtacgaccgggtgcccccgcacgcgtttgtccacttcgcgcgcccggagggggcgcgccgcgccgcggacctcgcgggggagaccaggctcatcctgagggggaagcccctgcgcgtcgcgtccgcgccggacagctcgctccgcgtgtcccgccgcagcagcatcgcgccgttccggttccccgacgtgcgcctcgaggtcggggcgctcccgtcgcccggcgcgttcctcgccgcctggcgcgggccggacgccgggctcgacctctccgtcgaccccttcgacgggtgctgccgcctcgtgttcacccgcgacaccgccttcacgttcccgggcttccgcgaggtcgccgccatacgctgcgacgtcaagctggagttccccgtgcgcgacgtcctggaggtccgcctgtaccgcctcgactgctcgctgctcctccgcctcgccgccgcgccgctggtgcactaccgcaccgccgacgacgacttccacgagccggtccccttcgacctgctcgacgacgacgacccgtggatacggaccacggacatcaccccgagcggcgccatcgggcggtgcggggtgtacaggatctccttctcggcgcgattctggcccaagatggaccgcgcgctggactacatgagggagaggagggtggcgatcgtcgattgcggcggcggatgggggccgcggcgggggctcacagtgcgcgacgagctggagttcggggagccaatgcaggacgtcttcttctgcctgcagcacgccgaggggctcaagttcccgctcctcttcatggtgaacgcgttggtgcacaagggaatcatcaaccagcaccagctcacgcctgaattcttcagcctgctggggagaagcgaggagaacgtcaatgtggctgcattgagggatttctggggggacaagttcccagtgtttgatgcgtgcgggaggctgaagaaggcactgaatcgggtggccaggaaccccaaacttctctgcagcaaggtcggggatgaccacgcggaggtgcggaggctggtgatcacgcccaccagggcttattgtctgcctccagaagtggagcgctcaaaccgtgttcttcggcattaccatgaggtggctgacaggtttttgagggtcacttttatggacgagggtatgcaggtgctgaacaacaatgtgctcaactccttcactgcaccaattgtcaaagacttgatgtcgaattttttccagcagaagacaacggtgtacaagcgtgtcaggatgttgttgacggagggtttccacatgtgtggaaggaagtactcatttctcgcattctcatcgaaccagttaagggacaagtcagcttggttctttgccgaggacagaaagacaacggtggaagcaattaggaagtggatgggacggttcacaagtaagaatgttgcgaagcatgctgctcgaatggggcagtgcttctcatccacatatgcaactgtgacaatgcggccggatgaggttgatgagagttttgatgatgttgtgcataatgagtacattttctccgatggaattggcaaaattaccccagatcttgcattggaagttgccgagaggctgcagctgacagataacccgccatctgcttatcagatcaggtttgctggcttcaagggtgtcatagctgtctggcaaggacatggtgatgggacacggcttttcctgaggccaagcatgaggaagtttgagtctaaccatttggtgttagaggtggtctcctggacaaagttccagccaggattcttaaatcgacagattataatattgctatcctcactgaatgtcccagattctatcttttggcaaatgcaagagaccatgctttctaacctcaacaatattctatcagacagagatgttgcttttgaggttttaacaacttcatgtgctgatgatggaaacactgcagcattgatgctcagtgctggctttgaacctagaactgaaccacacttgaaagcaatgctcttggctataaggtctgcacaattgcaggatcttttggaaaaagcaaggatatttgtgccaaagggaaggtggttgatgggctgtcttgatgagcttggggttcttgagcaagggcagtgctttattcgggcaacagttccatcattgaatagttattttgttaagcatgggtcaagattttcatcaacagataaaaacacagaggtcattttgggtactgtggtaatagcaaagaatccctgtcttcatccaggggatgtccgcatccttgaagcagttgatgtgcccgaactgcatcatctggttgattgtttggtgttcccccagaaaggtgagaggccacatgctaacgaggcatctgggagcgatcttgatggggatctctactttgtgacatgggatgagaaacttatacctccaggcaagaagagctggaaccctatggactactccccacctgaagcaaaacaacttccgcgccaagtatctcaacatgtaagttcaataactcttgagatgtcagcaatgtcccataattttttgtttcctacatacatgtcctttttatacgatggataaccctcctttcattggaagcatatatgggttttctttacagaactgagataaagaaattaaacgcaagctatggtcgggcacactggcacaccagcaaaaacagggaatagctttagaatctcagatatattacagcaatcaaaattaagtccaaaccagagaggtcctcctagcatttgtaaaccttataggcatcatctccctgctgaactaccgaggccatttcttcacatttgtgacttccctatcttctttacgtagcattaccttccgtttctgcaattacaactttatataaagtttaaatcaaccagctgttgaaggagtacatgattaattgccatctgtgtttctacctgtccaaatcacccctgaaaaaacatcaaacataacattttcaaccatttagggcctcacacctggatccaaggaaatccttgattggagttgggtgctctgtcctatctaagagcttttgatgcatatccatatgaaccctgataatttgcatgtaactagcaggttatcgcttgctcaaacgctgggcaactagtctctagtcttggtcgagtgtgtggttgacttggtcgtggacatgcttggttcttagatcgtgttttgtattcagggtttcttataccctttctttcttgcactgtccatattctaatgcaaatttagaagtaatgattttcatcttccttgttattttattatttggttatactatttgtggtttctagctgtcaacaagtaatggttgtggtttccttcatagttttagtatggttttgtgatatttacgaagttaagctttagcaaactattagcatagcatggttggttagcgctcattttattcaccatctgaatttacctcatgttatcatatattcctacttggcaagctgccaacttcaaattggaatatggtgatgtatttacaaagttgttaccatgtagattgttatttggatttgaaatctggcattggtgatacattttctccaatcgcatatgcatatagctgcttaaaaaactgactcatattaattcccctagtttctgcaaattgtagatttcttgatttgtgggcaagtatctattgctataatgcatatcattgactagatcttgtttttgtaacaggatatcattgatttcttcttaaagaacatgataagtgagaatcttggtaggatctgtaatgctcatgttgttcatgctgatcttagcgagtatggtgcaatggatgagaagtgtattcacttagctgagctagcagcaactgccgtggacttccccaagactggcaaacttgcgataatgccaccacaccttaaaccaaaagtctaccctgacttcatgggaaaggaagatggacaatcttataaatcagaaaagattcttggaaggctttatcgttcaatccaagaggcctccaatggtgatgtggtgtcacaagaggtttgcactccaaatgatctgccttatgacatagatctggaagttcctggtgcatcagatttcctcgcgagtgcttggcaatgcaagtgttcatacgacgcgcagctgagtgcgctgctcagtcagtacagggtccgcactgaagctgaacttgtgacagggcacataacgttccttgttaagaacagcagcaagaagcaaggcgacataaaggacaggctgaagactgcttactctgcactacgcaaggagttcaaaagtacctttgagagcatagcatcggatcaatgcgagattggtgatgacgagaagaatctgctgtacgagatgaaggcctctgcctggtaccaggtgacctatcaccccaaatgggtggagaagtcgaggggcattctgggcccagatggtgaggaaataccggcaagccttagctttgcatggatcccggtggattacttggcgcggataaagctaaggtgccatggtaaagtgagagttgaaggccaaaagcctgttgaaaggcttgcagcatacatctccgagaggatatgatgaaacaatgcaaaggtcgcagtaagaccactctgccattcgtaatgccggttcaaagggcatgcgtacaaaatatctgagtttttttttcttttcatttttgttcacttcactgaacttgatctcccgaatgtttcagtgtgcttttgttccttcttacatgcccctcaagcctgaaaaactgtacgtttcagttgagggctgtctatattatgaaatgcacaaatatacgctgcctgcagcttttggcaata

SEQ ID NO: 905 - DNA, 7194 bp, Oryza sativa
aacaaccgcacataaccatggtcgttaatgtattaacaattgcacataaccatggtcgttaataaagtaacgatgacatattgttcctgtcgttaatgaaataacgatgggaaaaattacgtggtcgttaatactattaacgatggagccttcaatgactagaactttgtagtcgttaatgaccacatttggacctttaacgaccacatttcccatcgctaataatcgtttctctagtagtgttaatcgccattgatgcatgggtaattgccctaccaatctcgcattcatgattttcacatgtctcaaacgtgaagagaacctatcatgcataaactcttactgtcactacataaatatcaaatcagggtgtgtttagttcctgaaaaaagttggaagtttgaagaaagttgagagtttggaaaaaaagttagaagtttggctgtatttagatccaaagtttggatctaaacttcagtctttttccatcatatcaacctgtcatacacacacaacttttcagtcacatcatcaccaatttcaactaaaatccaaactttgcgctgaactaaatacaacctttatgtgtgtgggaaagtttttgatgtgatatgatgtgatggaaagttaggaatagggggaaaactaaacacggcttcagtgccctcacatttcatgtgaatggatcaaagagggtactagcgaagtactataataaaatactacctccgtcccattttaagtgcggccatggtttttcgcgccgaactttggccatccgtcttatttgaaaagtttttgaaaaaatttaaaaacttgagccacaagtaaagtactattcatgttttattatctcgtaataacaaaaatactaattataaaattttttcaaacagttaaaatgaaacacagggagtagatcgataaaatcaaatcacttgcttagtcatgacaaattgattgctcacgattcagcttctttcataaataatgaaacctttgtacttcggcaacttttaaagattcttcataaaacagcagcaacacgaaccagacttctcatgtcttcattcaattcaacaccaacaactagacaaagcttaaaggtcccctgacaaagtgccaactctaagagtccccatccatcactcacagtgacatgtgggcccagctcctcacgttgaccgcagttgactcgttgacagcctcccgggccccaccagacagcgcgaggtgcgcctcctctttaaagccttcgtaaacgaggaaggcgaaaagcgggggggggggggggggggggggcaacgcaatgcaccacggtgaccaaacttaccttaactgaaacatggggcccaccagtgtggaccccactcgtcagctacccggggtaagcggggtggatcgggtgaggaccaaacgagcattccgtgcggccacccacccggtgcggttaccggcgcccccccctccataaaaaaccaaccaaggccacaggcgcgggtccgcttcggcttctctctctctctctctctctctcctcgaaaaccccaacacacacaacgcgaaccccactccgcgatggcgtccgccggcgatcgccgcggcggcggggggcctcccggctccggcgacgactccggtgaggccccgctcccgtccctctcccttgtcccggtggtcggatggccgatccccgcaatgtcggcggcggatgctgctcgttcgcgcgtagggtttatgggggtggttgggttgggttgggtttccccggggatcggtgcgtggttggcgtgcggggtttttgttttcgtgggggtttcgagatgatgtgtgttgcgggggggtggccgcagcgatgcggggggatttgggtgcgctgcgcgggtggattgttcgaggtgattggttctttcattttttttttgggtcgattggggtgtgtactgtgtagggggtttagtgccgtggtgctttgtgtggttgcggattcggtggtctcgtccatgtggttggttcatctgaaggcgatgggttttggtttgatttggttagtttgatccttctgtctttttagagcttcagagtttggtgttgttgggtatttttgggttcctttcggtgaggatttgtgttcactttctatttgaaaaaaagagagagatatatacgtattcaccttatggagcattcagttgtaataggtgggtttttatttgattttgcggctggttcattgtgctaaatttgtgttgttgaaataggatgccgtatgtgattattgtaagatcattgattattgaaataggatgtatgtgattattgtatgttttgaatgttcgcctagcttgctagatcgataattatgcccacatgcttattgtaagtttgtagctatgttaattttgcttccctgcgctcttaggtttatggtgtgacctccttaatttgtgattgatctatgcatgtgtgtgtttaggtctttactactgataaaattcaaaactcttagaactttgcaaatactacttcatgctgaatgattgctctactcagtctggtcagaattaatttacattttgtatagaactgttgatatttatctctatgaatattttgattggacataacattacgaaatatataatgcaatcctaaggtagtgtttacaattgcatttggagaccttttgatatctagtacatatttgtgactggagagagtgttcagtgttctgtattggaaccttttattgctttcatcatacataagagcatttcataattattaatcactggccttcatcagttttggtgtgtgtcaaggagctgcactcgtgaatctgtgcgtgcatgtgcatctgccttataatcacgtgaaaataacatgttatactaatttatgtaaatgccttgtatccagggggtggttgggagactgttgagaagagggtaaagaaaccagcgcaacaagttgggaaggggcaatggggacaatggaattctccaaatgctgcacctgcacctactgcaccacggagtggctctggagcttttcatcattctggaaacactttggttcgacattctgatcgtaggccagcaagaggcactcctaggccaccaccacaaaacaggtctatagaggcagaactgcaagcaccgcacggagttgtgactgcacctctggcaaatggttggcagtggggagccaggtcttgcccacctggtactgaaagcaaggagggtggtcttcctttgtctggttgtgatcctgaaacagacaatgctgaaggttatgacacatcggacgatgataatgatgatgatatgagtgacgatttgagtgatgactatgattctgatgcaagtgagaaaagttttgagactcggaaaaatcacaagttgttcaaaggtttcttcgaagtcctggaggcgttaagtgtagaacagttaaatgaaccaactaggcaatggcattgcccagcatgcaaaaatggacctggtgcaattgactggtacaaagggctacaacctttgatgactcatgccaaaacaaagggttctataaaggtcaagcgtcacagagaattggctagtttattggaagaagagctatctcgcaggggaacttcagtggtaccatctggcgaacaatttaggaaatggaaaggattgcgggaaagcactgatcgtgagattgtttggccaccaatggtggttgttatgaacactgtattggaacaagatgaggatgataaggtaacattttcatttgattgctgttgagtttcagtatagatctgaccagtttttctgcctgacttatatctttatgagcataacttttactcttatcttctattcatcattctgcaattacaggtcttgtctgccacattaaatttgtagtaaatatacatatttttggctattttcttgcttatttttttgtatctcgtaagaacattgagttgattctactgatttgtttacctattagtatcaaaagcaatgcacattcctcaggagcagttactatatgttgacttttgttactcaaatattatatattttttcttatgcactttgatataaattgattagcaagatttatcctcttcatcacacattttggttgaatttattatgttttgttccagcagatatttgttttctcaagtgttaaaacttaaaaaaaaaagacttcaaaattcactctctgttgtgattttcttgcatttatacttcattgtgaaagaataaaaatatgctgagcagtcagggttatctaggcgttgttcattaaaatgtatttcttattttctttattattgtgaaagaatatctgcttgatctattaaatgtgtctgcttttatgtttttattgcattctaatatctcctctttgtctcaatctagtggaaaggtatggggaaccaagagctaattgattatttcagtgaatatgctgcaagcaaagcacgccatgcctatggtccaaatgggcaccgtggcatgagtgtgctaatctttgacagctcggctgtgggctatatggaagcagaacgtttgcatgatcactttgttcgtcaaagaacagacaggaatacatggaacagtgctcacaaggttacattcttacctggtgggaaaaggcagctgtatggtttcttagctacaaaagatgacatggagacattcaatagacattgccacggtaagccatttaactatggtccaatacctgtacattaaattaattaacgctgtgtttttggtgcaattgtcattcatctgataaataactggctttcattacttttatctcctgaattctttctgacgccgattattattggtcacctctatgaagtgctcatgccaaatactagcttgcatttttatgatatgctgcatattcctgttcttcatcttcattggaatgtgatcacaattgatattatttaccgcaatatgtttctactaatgcttcacaacaattcataccttcatttcatttttattacgtagcatgttattatagtgtactcaatgctcatcagctgggtagctttctggtagtttatctctactacttgaaagcatgaatgtctaatctcattccattcaaaatgatatttcccttctgattgtaagaagaaaaattctatactcaaggacaatatgcaagggtaacttacctcttcggggacagcaaaggattagatctgtgcttctatattaataaaccttcagttatctattttctcctagaacatggaatcctatgatttatgctaggtatagattcatcatcattgggttcagcaagagtaatgtagcccattaataaaaaagaactgttaatgcaaaaatttaaatgatgctgatggaccctaatattttattacctttgtgcaatacggataggaggcatgtgcttgtcttttgtcttgtatcctttacctagtttcgttttgttgtttttttctaaataaaatacaccatttttaaagtaagaaagatactctagtttgcagatttctttcttttataagaacaattaattcctgagcattgcatttgggttacattcaaccctctacacttcgatagttttatttcttcatacgcattacaacctgtcaatctgtcattcatcatagcctctctgcatgtcagtttgacttcatatttgctatcctgttgatagtaaaatagaaggggaagtggtgcctgcctgtttgtaataaacaggtcctggcctcccaagtattttcacaacaaatgcaccacccatgtgactgtttatgtatcaattgaacatggccatcagtaatcttgattttcttagcttggctatcttatgattgttttattgtaacattaatgcaaacccctcttttatacctattgcaaattttcaggaaaatcccgtttgaaatatgagatgagatcttataatgagatggtggttacccaaatgaagcagatgagcgaagacaaccagcaactgaattacctgaagaacaaaatggttaagaaagagcagcactctaaattagtagaggatacattgagtgttgttacccagaaacttagggagacaatggaagagaatactattgtacgaaataaagccaaagaaaagcacttggagtatgagaaagaggtaacaattgcttaattggttaccctaatgaatatattttttggtaacatttgtatgagcagcaaccagaactgtcatatacttagtttacatatcagaaatattccgagagaacagatttctgcatttgaaacttgccaatttgccattgtcttgtacccttgttttgatttttgttcccttttcaccttgtggttttatacttcgcagatgaagtaccaggaggaatttttccatgatcaaatcgaaaaaattcacaaggccacagaggagaaagaaatcaagtttgagaagttgctgcaagaggagcgagcaaaggctagacaaagtgatgttgactctggaagtactgaagatcgcaggcaaaggtgaacaactagtttaatgtttttttgtgtgatgtcagttaaaattacgatccttagatcactcttctaggagcaacaaatttgaaatttccatttggaatggaaatgctccgcatcaatatataacctagtcgacattgtttcattgtgcaggaaggaaaagattcagaacttcatagactgccaggtgaaggatgttgaggaatttgaagccgaacgagacaaactgatcaaattgcatgaagagaagaaggtgaagctcaagaaggagtacctggcgaaggaatttgagcttgagaaggagctggacacagccctcacttccctgatggataaacacaagccggacatcttcaaatcctccacctcgccttcgacatgaagaactgcggcttaccatacatttcctgctcatctacaatagctaagactcccatttcctaagtacccgtaaaacttctagcgatgcgaaagcatcattctgtttgggtggatgcatgcctttggaaggaaacctgaaccagttccgtattatatggagtactatcagtttatggttgctgatgaactgatgactgtgcgctgcgcttttacagcaagcgtggaaatcgaatatatatctagtttatctcatcattctgctctgcgttgcatc

SEQ ID NO: 906 - DNA, 6921 bp, Oryza sativa
tacaatataatcttccatataacgaacttactagctatataatagactttttgtagggaattagaaactttcatatagaaagcaaaactttctttagataaaccaaaattgctaaataggcccacttacataggcatgcttaatcaaacaacaagaatttttttattatttaaccaaaaacttgtttagggcatgtttaaagatagacatatcttagtagttatttagagactattatcttgagactatagatatctaaaaattaatgcacaaaactaatttttaattatcattttgttttcccattttcataagcatagtttccttttataaacactaagagtccgtggtaagccgtttctcagatatcaatacataattattgatatcgatgtttctttctcttttttctgtttttatgtaatctaacttacaatctcatttttcgcttatgcttatacttacaagccaaaatttgaattttcaaccttaaatttggagttgattttggggtccttttatcgtaatttattttccaacctttacttttagatcgctaagaacacatatataaaagttgtattcacaaattattttttatttgcaaatatgccttgaataagccaaaccatggagccattagtatctttgttaagggtgagttcgaatgtaccattttctaacttatactctactttttttttacaaattttctataaaaaagtttctttacatccatattaatatgtttcaattcttttattaatactatttgattaatcatgcgttcatccaccactccattttactaactgcgtggatattagttttcgacccacaataacgaatacagtccatttggctgctattaacgaatctatcaagtatttgaagacaacagcatgcgccaattagcttttccctacaaggacgactccacatcatcatgtaggtattgtaggtgtcaatttggtaccttgttctgctttaaactccatcactaggctgccccatcactaaagcaaatgcaaaacactctcttttccctttaagagcccctttcaattaaaggatttatatagaaatttctcataggattgaaatcctatagaaaattttcctatttgaccctttgattcaaatgatagaaactttccaaatcctatgaaattcctatggaacgacacattgtatgtggattttggaggaaatttagcaagagcttcaacctcttggaaaatttcctttaagtctatatctctctcatccgattcctatgtttttcctgcgctccaatcaaacaacaattcctatgttttttctgtgttttacaatcctctgttttacacttcaattcctgtcaaaatcctatgtttttcttattcttttattttttcaaccctgcgattcaaagggaccttcaacctgcacaagtgtgaagtcgagggtgactcagctcaactctactagtaggaagtaggaatgcgaagggttcgtttcgtttccacaccaccattggtcaagtcaagctgcgcgtccaatcccacaactcactgacgcgtgggcccgggtcgtcctcactactactactgtgcagtgcagccagcactagtgctctcctgctctcctctgcttctcttctcctctcctctcctcaccgggagagtggagaccctcgagatgcccggcggtcgccgcggcggcggcgggcgtcctggctccggcagcagcagcaacggcggaggctccggtgagcacccctcccccgcgcgctcgcgccggcggcgccaccctctccgccggtaggattcagggcggtggcctcgtcgtaggcatgtgcgtgtatatgttttttttttattattcccgtagattttgtgctgtgcatggcctgctccgatccccagtttcctgggcctctttgatgagactatggtttactgcattgcattctgctccgtcagtaggaagtactacctccgtccgataataattgcatttctaccattcaaactttgtcccataaaaaatgtatttactataagatgagacccaacaaatggaatttgtaccccaactttccttttaattaatttgtagtagtagtaaacactatccggggaaaaaaagaaagtggcaaagcttttgcccttccttcagagaaaaaaatatattattattatttttttattagatatataaaatcgatcaggttagattcatcttggatctcatattttgctaggaggtatggtaagaaattttagtattttttcacactttgataaatatatcgcggtacttacttaatcattagtagcaaaccttgaggttggagactgtatgatgctaagtatgtgagttatgacttgataataagtatgctaagtagcaaacatgagaagttggttgcatgttccacagtacattttttagttgttcctttgtcgtacattgacacacataggaaaatatcatattactttatctaactgtttttgatgtagggtatagttgggttgagaagaagtcgaagaaatcggagaaatcagttggaaagggacaatgcgcaccatgtacttcttcaaatgctgcacctaaacctgctatggcgtggcaagcacggagtggcaatggatctttacaccctcctggaaatggtcgggttcaacattctgatcataggcctgctgccagaggcagtcctaggtcactgccacaaaataagcatacagaaacaaaattgcaagcaccgtgtccagttgtgactgcacctcttgcaaatggtttgcagtgggtacccaagtctcgctcatctggttctgagagcaatatggatgatgctcctacatcaggttctgaccctgaaatggacaatggtgcaacacacccagttgtgactgcaactcttgcaaatggcttgcagtgggtgcccaggtctcgctcatctgactctcaaagcaacaaggatgatgctcctacagctagttctgaccctgaaacggacaatgttgcaccacacccagttgtaagtgcacctgttgcaaatggcttgcagtgggtacccagatctcactcatctggctctgaaatggacaatggtgaggattatgattcatatgacgatgattctgatgatgatatggttgatgataccagtggtgactttgattctaaggcatctgagaaaaattttgagactcgaaaaaggcacaagctgttgaaaagcatttttgaacttctggagaagttaagtgttgaacagataaatgaaaagactaggcaatggcattgtccagcatgcaaaaatgtacgtggtggagttacctggtacaaagggttacagcctttgatgaatcatgctagaacaaagggttctaagagggttaagcttcacagagaattggctgcattactggaagaggagctgtatcgtacgggaatttcaatggcatcatctggcgagttctttggaatctggaaaggattgcgagaaaacactgatcgtcctatagtatggcccccagtggttattattatgaacactcgattggaacaagataaggatggcaaggtggtgttttctatttcttgctcgagctaaaaaatattttgcttttctatatcattttctgttgcattgtatctggaagttttttgttgtccaattgtaagtcatgttgtttatttactgactatggtgttgtattaggtcgcaatatttatttcttcgaatgttattgaattttgagtaaatttcataaaccccacctgttatggtccaagttacacaaaaccatagggattttgacacgtggcacataaccccgatggtcataaagtttcacaaaaccacactattagccattttgacatactcctatatcaaatattttaaaagtggatgtaacatttatatgatggatagaatcctcataaatttgagatatgattgtaaaactcaaaagtgttgtagatcaaaatcaaaatgatcaatagtgtggttttgtgaaactttaggaccataattcctgtggttatatgccacatgccaaaatctctatggttttgtgcaacttgtaccataataggtggggttttatgaaatttactcttgaattttagttatgggtaatgcacatggattctactaaacctaaattgtacacataactttatggctgtccactattctttctgtaatatctgatctaatcagttgtactcaatgtgtagcaaaattaaagaaataagactgatttgttttcatatggttctattgatttttttttatctattactacgtatcattaaataaaatgtaaatgcatccttcaggagcagttaagatggcaaatgtgatggtttccattacttaaatatcagatagctgtcatatgcattgcaatatcgatccatggacacggtttatctccattaccagtttattttgtttatcattcttatgttagttattattttatgtgccagcaaacatttttctttgtgttgaaggtttaaaatatttacaatattcaaataacataaaactgcaagaaaacatattgtagttattctttattatgttttgcttgcattcatactccactgcaaagaaacataaatatggctactaattaggattgtctaggcatacttggcccaaccagttgaaggtcattgtacaaaaacatccatttgatctatcttttaagctgtatgaagctaagatttacttcattctaatttatatttctcccttgacttgttccagtggaaaggtatgggaaacaaagagctccttagttatttcagtaaatatcacgtgaaggaagcatgccatgcttatggcccagatgggcacagtggcatgagtgcgctaatatttgaaggatctgccgtggcctataaggaggcagaacggttgcataatcactttgttgatcaaagaacagacaagtatgcgtggttgaatcataggatcgtcatacctggtgggaaaaggcaactgtatggtttcttagctgaaaaagaagacctggaggcgttcaatagacatcatggtataatgtttaacttcttttcatatataatgctctgaactctgtgcaattgtatgtgtttgttgtcttttgttataagcatttaaaatggaaacatgatccatacatgttcgcatgtttgaaaggtgaacattataaaatatcattttggaaccttttattgtacatgagagttggagtattgtcagaacgaaatgcatcacctgtatgactgtgtattcatctaatttcctggttttcctgacagattagctttgctgttgcatgtcaatttcaacataaattcagactatttttttttaaattttgtatgattttcaggaaaagactatttgaaatacgagatgaaatcttataacgagatggtggttacccaattgaagcagatgagtgaagacaaccaacaactgaattatgtgaagaatgagatggttaagacagagcgacattctaaagaagtagaagaagccttgggtgttgagacccagaaacttcagggagcaattgaagataatattattttgaagagaaaaaccaaggagatgctctcagagtgcgtggaacaggtattgattgcttaatagttaccctggtgtacatattttctgctaccacatgtatgatctgcaaccagaagtaacataactataaaaatctgcttggacactgcctcctaaaatcttaatacaaagatatgcatcgctcttacgtattcctgaaaaaaatctgcttggacaggcagtcttctgcaattaaaacgtttgccatagaatcccttttgctttgtctcatgttaaccttgttttgattttgtctcctttcctcaccttctatgcagatggagtttaatgcgaaattttatcatgaacaaattgaaagacttcgcaaggacaccgaggagaaagagaatgagtttgagaggttgctgcaggaggagctagcaagagctatagagtgtgatgttgactctgaaactacagaaaattgcaagctaaggtgtgaccaatacgtggttgggacttgggagcagttgaaaatttgatagtacttctgattattcttctattgatcaaatatagatatggtgtctctgtgaatggaaatgctccactccgatatatcactaatccaaaaatattttgtgcagggaggaacagatacaaagaatcatagattgccaggtgaaggatgcggaggagtttgatgctgaacaagatgaattgatcaaaacacacgaagagaagaaggcgaacgtcaagatggagtatatggcaaaggatgttgagctcgaggaggagctttatgccgctctcacaagtctgatggagaaacacaagccggacatcttccaaccgtccagcccttgaagagctgcaggcttgcagctcaccatatatatgccctgctcacaataatctcaagaggtccctctcccaaatgaacttcaatttacatgccgataaattgcttgaaatgctcagaaactctcccgagtggcgtctctgggcaattgtgttgcacccccaatttggtgttttgatctgcaatttttatgcatctgcaaaggtcaatttgattgagttgacaagaatacctgttgctcaactcaaagatgatgtgctattcttgtcaaacatataactctacacggttttgatttcacttgcaagtttgtgaaaataaaagtaaaacagatggttttactttgcaagtaaaagaatttcggaactgccaagtccgtccctaatatttctagagattcagaaacatcacatgtttttgggttactgcaagcatggtttgaagtttggacttcattttggaatgaaaaatctgttcgattgtcatgtatggaagc

SEQ ID NO: 907 - DNA, 8465 bp, Oryza sativa
actccctactctcgttttccatgcgtacgtttttcaaactgctaaattgtgcgttttttgcaaaaaatttctatacgaaagttgcttaaaaaaatcatattgaccctttttgaaaaaaaattaatacttaattaatcacgtgctaatagaccgcttggttttccgtgcatagcagatggatcccaaccccaccaacggacacagcctcagaaggacacaaagactcgggttgctctaatagccaacaaacaggaggatgtgcacacctagcaaaagaccttttgggaaacagggacttattccaagtacctgtcacatcggatgttcggacactaatttgaagtattaaacatacactaattacaaaacccattccatatccttgactaattcgcgagacgaatcttttgagtctaattacgccatgattcgacaatgtgatgttacagtaaactttttataattatggattaattaggcttaaaaaattcgtctgcatattagctcttatttatgaaattagtttttttattagtctatatttaatactccaaattagcgtccaaacattcgatgtgacatggatttaaaaatttttagccccatctaaacaccccccctaaatgcgttttgtttgttctcttgttgctttgaaactttctaaggccaaattttccccctaagaatcaccatgtcgtgttgagtagcagatctcagctaattctatcaacgaaatggtatatttacggttctggctaagttctacacagattatttgctcggctattttatcatttatcgtgaacatgcattttaaattactaaacagtattttaaaaaagttatatataagtttctttaaaaataaaataaatctattttctaatattttataaaagctacttcgtaaaacttaattaatcatgtgtcagtggcgattcgtgtgctactaaaataagataaaccaaataatcctatggaataaagcattagatgtaatcgacgataccacgctacatgaaaaaaagtagattaaccgtttatttttttctacatgcatatggaccatttgcattaagaatatttcacaaaagttagggaaacgaattataagaaaaataatatgaccgtcattctccgttttttcatagtctacaaatatttattaataagttgattttgtaataactctatatttaactaataaaaatcaatgtcacgtcaattcaaataaattaatcgtttaaaatccacacgtccctgtctcaaaataataacatataaataaatattataaagatatatcgccgtctaatcgaagcgatattccataattaaccctgcacctctcagggaggtgcagttgagcatttacttcactctttttctcgagaaacccaccgggttgtcgtctggacctgtttgtcagtgactgtcgagagcacgaggtgatgggtgcacgggccttaaagtttaatcctctatggattcgattttttcacttatttttttacttttcggtgaagcccgggaaaaagggcgctccatttcggagatttcgcacttcccaccccttcccttcgcttcctccctccctcgcctccgcctcatcgccgattcaaccgattcgccatcgccccccacctcgccgccgtcgccgccgccgcctcgtaaaccggtgggattttgcggggaggagggagtttggtgcgggagaagggggcggaggagtgggtggttttgttttttttttttttgtattttgtttttgtgtgtgagagaggggggaagggggcaatggagatggacacatcgccatcgtcttcggcgccgtcgtcgccggcggcgtcgtcggactccatcgacctcaacttcctgccgttcctcaagagggagcccaagtcggagccggcttcaccggagcgagggcctctgccgctgccggcagcggcaccgccgcctccacctccgccgccgcccccaccaccgccaccgcaggtgcaggcggcgacggtggcaactccggtgccggcgacgcccgacctctcggcggcggcggtgatgacgccgctgcagtcgctgccgccgaaccccgaggaggagacgctcctggcggagtactaccggctcgcgacgctatacctgtcgtcggcgggggcggccggcgtaatcgtgccggcggcggcgccggaggcctccgcgggggcggtggcgcagcccgggtcggggtccggcgcgaagaagcggcggccgcggtcgtcggagctggtgcgggtgtcctcgctgagcgtgcaggaccagatctacttccgggacctggtgcgccgggcgcgcatcacgttcgagtctctccgcgggatcctgctgcgggacgacgagcgcgcggaggtgctcggcctcacgggcgtccccgggttcggcgccgtcgaccgccgccgcgtccgcgccgacctgcgtgccgcggcgctgatgggggaccgagacctgtggctcaaccgcgaccgccgaatcgtggggccgatcccggggatctcggttggggacgccttcttcttccgcatggagctttgcgtgctagggctacacggccaggtgcaggctgggatcgactttgtcacggctgggcagtcttcctcaggggagcccatagccacatctatcatcgtgtccggtgggtatgaagacgatgacgatcgcggcgatgtacttgtgtacacaggacatggtggtcgtgaccccaacctccacaagcattgtgttgatcagaagcttgagggtggcaaccttgccctcgagcgtagcatggcctatggtattgagatccgcgtgatccgtgctgtcaagtccaagcgcagccccgtcggcaaggtatacttctatgatggcctctataaggttgttgactactggcttgaccgtgggaagtctggcttcggtgtttacaagtacaaaatgctgcgcatcgaggggcaggagtcgatgggctctgtaaattttcgactagccgaacagcttaaggtcaatgccctgactttccggccaacagggtatttgggctttgatatttccatgggtcgagagatcatgccggttgcactgtacaatgatgttgatgatgatcgtgacccacttttatttgagtatctggcgcggccaatatttccgtcctctgcagtccaagggaagtttgctgagggtggtggcgggtgtgagtgcactgagaattgctcaattggatgttactgtgcacagaggaatggcggtgagtttgcatatgacaagctcggtgctcttttacggggcaaaccactggtatatgagtgtgggccatattgccggtgcccacctagttgccccaacagggttagtcagaaggggcttaggaatcggcttgaggtattccggtcaagggagactgggtggggtgttcggtctttggatctcattaaggctggaaccttcatctgtgagtttagtgggatagtgctcactcatcaacagtcagagattatggctgcgaatggtgattgcttggtgcggccaagcaggttccctccaaggtggttagattggggtgatgtctctgatgtctatccagagtatgtggcaccaaacaatccagctgttcctgacttgaaattttcaattgatgtgtcaagggcaaggaatgtggcttgttatttcagccatagttgcagtccaaatgtgtttgtccagtttgtgctgtttgaccattacaacgcagcttatcctcacctcatgatctttgccatggagaacattccaccattgagggagctaagcattgactatggaatgattgatgaatgggtgggaaagttaaccatgtagtcaggctgtctactagaaggcaatactcagtttatcttcctttgttttgatgctttcataatccttctcatggagatttttgaggtgattgctgacaacaagtttctctgatggtaactctcccagtccttccatgatctttttattttgagatttctaggattatgtttcgaactcagtacttataatatgcctttataacaagtctacattacttgtgtgtgaattgcttcaatttgcattttctgtacctccttttgattgacctgtattacttcctacttaattagtattttgtttatctcttgcttattcaacttcattgcatttttcaatgctgggatcatgattcataaattggttgtggtacttgaaaagattgaatgaagtaatgaattggttaaagtgcagccttgtgaagtagtgctcctgggtgcatgcgttccttgccctctataaataggcaacaatctccatacatatgtaccataaatgttatctttgatttactagtcttcatttctttcagtcagaaatatttggattttatcgtactattggtggtcagctgctgatatgtgctgttcaaaaaaaaaaaactagtggtttcaaaatttagtttgaaattaaatatcttataccaattatcatgatgatttctggggatattgttcttcagcctggcttatgttagaatatcaattatatattgttacatttttttgcatcgtttctggaatctggaggtcaatctagcccatatatggtaatacgtgcccatataattccccaacgagctttatggttgttaagtagtaaagttgagtcaagttgcccctctaccgacttgagagttgacactagtctttggtagtatatctgacttttactacatttactggttgcttctaccactcgtcttgcactacatgctgtgctgatggacctaatggaactcttttcttatctcccttcattcagtaataatgggcctgacagaccaagcctcctaagcaactcatcgttgctgccttgcttcattgtgtcttctactgccaacaacttcttgtgccctcaagtcatcctctctggccaatatgtggatttgttttgtgggtttgatggtaatgttatccatgatgctactatgggacacatatgttcacagtaaattgggttcagtgacctaataaaagaaacaaatattattaagattaggcaatgccatgatttagaaataaacatggccttgtgccatctcccaaaactacctaaaaatagaacaaaatgtgtttgatctccatgtataggcagtaaaaccatagttttgcggccataactatttggaagcttgtttcatggcacaccatgagaaggatgcacacatgtatctgcttgtcctatgttttatgggctcatggcactgattgtaaatgtgaatgtctggtccaccattatcttcatatgtgattgtacttagcatgcctatagaagcctatcttggcatcacttggatggagtttattgaaaatactctcatgtattttgatggtgtgtttggttgagggaggagggtggatgggataggaaaatgcatgatggatgaaatggtctagaatggactgtgatacaagttgtccctccatctcaaaatatagctacctttagcattcaagttctgttaaaacaaaagttctcatcaggtgttagcgctatcttgttcacttttgtcaactgaagtcgcgcccaaaatgtagctacttacacctaccagtcatctcaaccaatcacaaccatctcatttaatttctccacctacttactcatcccaaccaatcacaaccatccccatttaattccacctacttccttaaccaaggtagctagctattttgggacggagggagtagatgtttggttggttacacagtatggtacaaattttctttgcttggttgtgtcggatggttcaggatggtaccatacgatgtttggtttgtaagatgacaagtaggatactgtttgacacgcatgacccacagcatggttcaacattttttttctcacatggaattgtacagaatcaatatagaatattcctggaatatgtatcccaccatccgggaggatattatcccatctgtgaaatcaaacagcatgatcaaccttgaagttgaagatcaaaccatccactctcatcccctcatgcatgcgtgtcagaccatgccatgtcatagccttgccatgccaacgtccctggcgcggcaaggaagcgctgcaatgccgtgctccttggtgtggcataaatggctgctagtgcttgcatgcgtgtcagaccatgtcgtaggtagctgcatgctttgcctgtgttagctagtaggtgcataccattgatcaccactctttgcatattttctagatattcatgtacagtaatatatgaagataattgtcataaaagttactccatcccataaaaattaaatctagtacgggatgttttttatgggacggagagagtacatcatatatatcacttttacacaaatgcatgtatggctaaattacatctataatttcaaacaaaataaacaaatagttatgagtaaccactgatatagcagagcatgtagggaccggactcatactgcatgctttgtttttcctatggcactttcaaaggactcttattattttttcctgtgtttttttattgatgtaggatttaagaaacatactattttaatttttgtgttttttctattcatgtatttttcctatcctacaaatcaaagggcccttcactgagtggcttgcgactttgaaataattcagagtgcaatatgttgtgaccccctcctgtaatataatgacatcacttcaaaaatacttttaaacgatcaatcaacattatttgttagctagctggcaactcaagctaattaattaaagtgtcatacatgtatggcacgctagggggccattacctccaataggcatgcaaagcctgctcgcatccaaaccagggcatgatcagcatgcatgcaaatctccgtcatgccgcagggcacggcaattcagagcaaggttgtcacgccaaggatgttggcatggcaaggctatgacgtagcacagtctttcagtgtgtcacgttccatcatgccagggttatttggcaacgccagtattcttggcatggccaaaagattcagatttggaaataaaattttaatagggtctaatattaaattattatatgtaaaaggtttaagaaataaaaacaattctgcgtgttgatcattgttgttaagttgtaaactactaaagtcaagttgatgcatccttctaccaacctgtggaccagtcattactagtcgatgagttgattagtgttttataaaggagatcagggaaaagagggaacacatgagcaaaggaggtgtgaaattcttgctgcttcctctaatctggctctagctctggtggctggctatatatggaagaggaaaataactctcctctttttcccctttcctatgaacttggcctcccaaacaagacccagtttgctctcaagcagtcccaagttgagtcgtgtccctctagttgtgctctatggtcgacttgtcaactagtcacctactgtgtaatagtggtttggatttgctgttgggacggtagacgacactctctctttgtctaaatagtagtgatttgttatgacatgactttttctgcgtgcgttttaaattactgccatgctgtaccatattgttttgcagatcagcatcctatttgtttttaccaaagcattttggtctacagcatatctgaggtggttattgtattttacatgttcaaattcaatcagctgtttctactttgctagtatttttttttatgttagctttacatttttccaacaacatcattatgcatttttgtcaaactagtgcattgctttcatttcctgtaaataatagttacactccttttttttaactcatcattgcccgtaataattcctttcctttttcaaatatgaatgaacctgttatttcttatttcaggcgaataacagaagcttgcatatgggatgatgtttcaagccttcccatgaggaaggcaaagtcacagctcattgtcatccactaggcatcaaccgtccgttgtatatttttgcatggtagctgcagtgccccgtggctgattccctctcacccttgaagcttgatgcttgcttttgtaggaagcttgttttgcgcagcaagcaccgagtttcatacttgacctctgtttttctttttttttcccttcaattgctacgagaactccatatgtacatatatctgtacattacatgacttcaaaatgtgtcccacttctgtctgtaaatgctggttggccatgtcttgaatggtagggtagctcatagatttggagctcttacagaggctagtcctggagaggcattctgtccaggacatatatatgccgtactgatggttttgctagctattcatatattcaactgtcgggctactggtgtcaatgtcaccctggtatctacaagtgcaacctgttgaggtggtcattgtagagatttcatcagc

SEQ ID NO: 908 - DNA, 11155 bp, Oryza sativa
gcattttgcggcccgttcgtagaaagaggctataccatatatggtataccatgaaaaaaaatgttataaattacacgtcgtataatcataatatactataacatatctagatttattctatctttgtagttgtttgctccctatgaaatactagcaaaatattaatatttagaaagtagagaatattgttatacatattaacttgaaaaacaatatcacatggtcaatctcaatagtgaagcgttaatctccctagtttcatgttctatctatgtctatgattaccttgttttcttttgttgatttcctttcataagacagtaagagccaattagagaaggaataatccatcaagtttcatgttactttttaattcactgattttgcactcattaatcttcatctgaaagacaggtggtgataatctcgtgacgtctcttgtgcccacttatctcaataggcatatatatgcctgtgctccagacaaatggccacctggctcagtcaagcggacatcccgaggccaaaagagttgtttgagagaaaacattatgacacgggtctgacgagcatcccgaggtcaaaaaaaagccatttgagagaaaacattgtgagcgtgagaggtgcaccaggcacacggtcgttgggtccacaagcacttaacgcgtaggaggagacgtcatggtagatgagtgttgcatatcccgtttgtaaaaagagactataccatagatggtataccacaaatcaaaatgttacgagaattgcacatcttataatcacaatgtactataatatatcgagatatattctttcttttagccgtttgctccatataaatacaagcaaaaaaaactaaataatatttagaagtagaggagattgttactatattttaacttgaacaacaatactccctccatttcgaaatgtttgacaccgttaactttttagcacgtatttgaccgttcgtcttattcaaaaacttttgtgaaatatgtaaaattatatacctacataaaaatatatttaacaatgaatcaaatgataggaaaagaattaataattacttaatttttttaataaaacgaacggtcaaacatgtttaaaaaagtcaacggcgtcaaacatttcgaaacggagggagtatatcacaagatcaataagccttaatctccctagttcgatgttctatatagacagttctatgattcccttcttttctttggttgatttctttctgtatttccgttagacggtagtaagagccacaatgctatggctgcaaccgctcaattcgccgctcatccgcaatcagcgcgcccgcgccgcccactcactcacagccggatgggcccgatcatccggcgcgagagtgggtcccacctgtcagtgagtgccaccaaaagcgggccgatcctttccaaaaatccctcgtgggaccctcggcttgacccgccccggctataaatagccccgcctctctcctctccttgtctcatcaaccctctctctctctctctctctgcctcggcgacctcgcctccgcttactctcccacccagacaaaaccctctttgcctctcatggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagatggcgttcgccctgctatggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtaagcctcccctagctacattaaccctactcgttcttccagttcccctttcatttcgctttcgttgcgattatatctctagtaaatcgctttcatccctcgtagactagtagaataaattcgttgcgatgcgattcacgaatcgatcaagcgattcgtatacttctagcagtattagattacagtgtactggagtactacatctggtggagtattattttttatcttcatcatcttctcattctttttttttttacctttatcttgtatacacgcggtagttttcgggttgccgttttgggcgaaagctccgcagaggggccatgtgccgtgcttgcttcattttcggtatccatcatcaactcagctctcgcggctaaatcgtggctttagacctttagtacttcggtctctcgctgttgctcggttttgttgttatcaccacatctctgtctgaatccttaggtagtagcctcgtgcatctgtgcagagttgatctggttgctgattgaggaaaagggtcttggtccactgtgtggttgcctggttgatgagatcttagtagagttcctgtgtctttcatctttgctatttgtgccctgaagtaggggtttgggtggtgtgcatgtggtggaagaagggggatcttcgggtttagagggatgaccgaggcggcgcagcctcagccgcatgggagaaggagaacggtgatttgatgttggtggcgaggaatctcatcggactagctaggagaggtgagggaaatggtagaggagaggcatgtaggggtatcggtggcaaacttgaggaagacgataatagtggcggcggaatctgacggagaactcgtggggtttgaggaaggtagggtaggggtggcggcgcgcggggatgaggggagggagtgagaggggggatattagggttagaaatgcacgaatcttcgggcaatcttagccatccaaaaaagtgattgacatttagcatataccccctttgtcctaaaataaatcaatatccctcgcatcctgaggagaacaaaagacctaaatacccctcattattgggtgggaacatttaatgtgaaaaaaagacaaaatacccctcgttaatagaaaaattgtattggtgagtgggaatatttagtgagaataaaagatcaaaataccccctcgttaataagaaagttggattagtgggggtggaggtggcggcgtgaggggtacgagggagggagggtgggggtgacggcgcgcggggtataaggggattgagtgagatggaggattagggttagattattatagagcccacacgaatctttgagcaatcttaaccatgggaaaaagtgattgacatttagcatataccccttttgtcctaaaataaaccaatatccctcacatcttgaggaacacttagtgagaacaacagatcaaaatacctctcgtgaatagcaaacttgtattggtgggtaggaacatttaatgagaacaaaagaccaaaatgtccctcatttgtagaaaagttgtattggtgagtgggaacatttagtgacaataaaagaccaaaatgtccctcattaaaaagaaaattggattagtgagtagaaagtgaaagattgaaaggatgaaacttgtcaatttatggactgagaacaggtaagagcaagtacaaatactacgctagctactagctattagaaataccatgctagccttgatgccgagctggaggtgaacaatgtgatgagagagagtaagtgggtcaaaaaggttgtagcttgtactattgttgtagcatgcaacgagcatgagttaaatgcgtttcttagagtgatggccccactctgctctgggacctagccggtcgcacaacccgcctaggcccagagccagccctgacatgtataataggttagctatggttagctcaaatttttccctactccctttttctctcactatgaatttaacacatatcttgaaacatgtgtagatctagcttttgtatgagaacaaacacttgttacttttgtttgtctctcttttaggtaagttttatagttggtttataactcattgttagcgatcctagtcgttcctatcctttttgacgattagactgcatgcatcttttttttttcaggtgagtttgagtcccccaccaaagaccaggcgcatcaacagggtagtgatgtctgagctggccaggttgcaccgtgagtcgcatctcggtggcataagcttcgcgtacgacggaagcaaggccctgtacactgcaggaaaactgccgttcgactccatggacttcaagatcaagctgggcaaagagctcagggaaatgtgagcattgtcactcctaattaatgtttactaacacttgtgtactctagctaggtttcttgtttttctgatatgtgtttagtacattttgtacatctagctaggttacttatttctggaaaatgtcttctacattttatgcactctaactaggccacttatttttggaaaatgtctagtacacatgctagactacttatttgtggataatgtttaactacacattttgagcactctagcttggtacgatacttatttgtggaatgcaccaactaactaatgaaccgtttaatgtttgccttttcaattgaaaattaagcgagtacaaggtgacaattcgacgtgctggccaagcagatctgcaccacctgcacgagttcatcgccggccggcagagggactctcagcagcaaacgatccaagcactggacgttgtactgagggagtcaccttctctgaagtatgatgcctttcgtcataatcacttttttaggaggcaaaaacgttttagaccataagattgatttcttgatatctttgcattttgcagctatgtcatcgtttctcggtcgttctactccactatgttcggccgacaagacattggtgatgggctggaatgctggaaaggatactatcagagcctgcgcccaactcagatgggactctcattgaacataggtgcataatcatctctaaaacctctttattttgggcggataattgatgacacaaataatccaattcagttttatttgggcctctatattgaaattttggcaaaatatgcaccctacacattcatttttgctaggtggtttccttattttctttcttgccaaagtagacaacacttcccattaattttgttcagttgtgttgaacttatatttacacaaagcaagcctatttagtatttgttttgtttgctaggcctttataggcgcacacacgcacattggtttttatggaaaccggcatccccattagtatattgaacacttttacaatgtttcacacacaaccaaaaagaattcataactgtaagacacaaagtaatgtgaacatgcaaaaacatcttacagttcaatttttattttcacaagatttacttatgcagctctttttatgcatggtttattagcattgttactaactcttgaatcttgattgggtcctcgtgctttcagacatatcctctaccccattcttcaaacctatcagcgtggtagaatatgtcaagaattgtctgggcacacctactaatgctaatggccctgaccctaggcggcctctttctgacattgatcgcctgaaggtacaaatttctcaaccaaaatgtgtgacccaataacttatctatagttactgacttctttattctacttaaaatttgttctccaggttaagaaagcactacggggagttcgtgttgaaacaacacaccaggggaagagcagcaagtacaagatcactacgattacatctgagccactgagtcagctgaagtaattgttcctctcttctcccccttgcttatgtgctctataaactataatcatactttctaaactcacaacttgtatcttgccattttctgtttctagcttttctatggatggaactacccagactgttattcagtacttctcgcagcggtacaaatacaggctgcagtacacgtcttggccctgtctgcaatccggcaacccttctaaccctatatatttgccaatggaggtaaattgtgcatttcttttgtgcatgattccagaaacattatactaactgtgcatataacacgtttgtaggtatgcaccattgtagaagggcaaagatactccaagaagctcaatgacaaacaagtgactggcctcctgagagcaacatgccagcctccccagaaaagggagcagaaaatcattgaggtaagtgtccagctcacatatattgacatttgacattaccttcttttgtgaggaattttacggtccttaaaaaggtacctaaattttacactaaaatttttggtaccttgaggtactttgtatctagaggtattaaattttatcctagaaaaatatggtacctctaaactctagtaccttctcaaggacggtaaaattacccatcttttgtagaccaggagagtaattacttttagtgcttatataatgatttttcaagagtcccatgcatctctttctttatgtgagatattatcaataatggtaattttatcatccttgataatgtactaaaaggtacacatttttttactgtaaaatttggtatctcgagatacttttagccatgaggtacctgtgttaccattctagatattgtgtgtatgtttaatcaaatgtgttgcatttactcaaaaaaaaattcaaaacatgtcatttattgtagtacacataaagtggtgcatccctaattaatggacaacccacattcttcttttagaattttgttaagcatgcatccaacattctaatttggtcatgaggaaaaaaaacatcactcctatttatttatcaaacaaagattgggacattttgatgttttaacatacgtgttataactactaacgatctaacacgattatatttatttattgtatagatggttcaacacaacaactacccggctgataaggtggtgagtgattttagaattaatatttccaatcagatggccactatgccagctcgcgtgctgcctgcgcccacggtagctattctacaactcattttggtgttttttttaatctcctgtatttttatacttatgtgaccttttacgttgtttcagctgagataccatgactctggaaaggagaaaacttgtaatcccagagttgggcaatggaatatgatcaataaggtgatacaatgttgaatgcttccctgaacaattttttttacaatataatttctgtgttattactattatttgacattacttgaaataattcatcataccgaccttgtagagattggttgtgctctgctcattgcatgtctttgaaacttgtgatcgcaatatagtggatgtcacacttttcattttggaagaattagtggatgacacatgaaagcttttaatacgaaactattaacatatgcaatactagatttgaatagccttctttctgttgttcacttgcacatttgtttgttttctcccagaaaatggttggtggagctgtggttcaaaagtggacttgcgtgaatttttcacgcatgcatattgatgccgtgcacagactatgcggcgaactagtttatacatgcaatgctattggcatggtgagcttgtgttatgcttatgaatatatttaagtttgaattgttagtcagcacatataacaccgtgtttgtcttcgtaggttttcaatgaaatgccagagatagaggtggggtcagctgctcctaataacatcgaagctgccctgagcaacattcacacaagggctcctcaactccagctgctcattgtgattctcccagatgttaatgggtattatggtatgtacacattcttagttaattaatatgactgcaagctcttccagtatatatttacacagtaaactgtgcaattttgcaggaagaattaagagggtgtgtgagactgaacttgggatagtatcccagtgcctcaagccaggccgcaagctcttgagcttagacaggcagttcctggaaaatgtctcactcaaaatcaatgtcaaggtaagctttgtttgtggccactgcacttaaaatcacttaaaaatctccctctccgttttatatacgaattaggtgttcaatggagagatgtttacactgtcttgatcaggctggaggacgcaactcagttcttcagagacctcttgtacccggtgggcttgaaaacacaacaataatttttggtgccgatgtcacccatcctgcttctggagaggactcatcggcgtcgatcgcagctgttagtttctctcatttcctgacatcaaattgtttacttcatcgttgaatgaattgaactaaacgaaattttagtggataattgaatggaatttattttgatgaaatatttttttaaaaaaattaacattgtgacgcaggtggtggcctccatggactggcctgagatcaccaagtacaaagccctcgtctctgcccagccacctcggcaggagattatacaagatctcttcaccatgactgaagttgcgcagaatgctgatgctccagcacagaaggctgaaggttcgaagaagaatttcatatgcggcggaatgttcaggttagtttttcttttttgtcctgagatcaaattgagaaagtggcaatgacattttggcttgaaacttagatgctcttttcacttttttttttttgcagggagttgcttatgtcattctacagtaagaatgctaaacgtaagcctcaaaggataatattttacaggtatccacttcaaatcatgtctctattgtgtcaaattactagatacctagataaacttggattttataattccttagaataatatgcatccaaatctggacctatttgtaatttggtaatgttttgcacacgcagggatggtgtaagtgatggacaattccttcatgttctgctctatgagatggacgcaatcaagaaggtaatgatctttgattatgtacgtaactacacttttatcatgtaggttgcttcatgacattttcatatatttttttgttcaaaggctattgcatctttggacccagcatacaggcccctggtgacatttgtggttgtccagaagaggcaccacacaaggctcttccctgaggtgcatggaaggcaagatctgacggacagaagtggaaatgttcgtccaggtatataatttgcctatgaaattatgaatcctagctatctgttaccagaaaacacataattagtgtgatgcctgtgattgtgtattacataatattttgtaattgtctttttttctaaattctgtgtgtgtttgtgtgtctgtgtgtgtgtgtgtaagattgtgtgtctgatacactttctggtatatatgcaggaaccgtggttgacactaacatttgccaccctagtgagttcgacttctacctgtgcagccatgccggaatccaggtagatatatatttacacaacaattttattttgctcatcgtggatttctttttttcccatttatctttgtagacgactgaaatatcaatgatgtgaaattgctcttgtctgtccagggaacaagcagaccaacccactaccacgttctccatgacgagaaccgttttagtgccgatcagctgcagatgctcacttacaatttgtgttacacgtaagcctctgaattgtttctcaacttttgcgttgttaatttgtaccatccataaacctgacctgatctttgccttgaaattttccagctacgctcgatgcacccggtctgtctctgttggtaagctttcatcctaatgctctagctgaaataacacatttttcatacttctagagcttgtttttttctatctttttaaattttccatacttgcacagcttattttccatagagctaaatttacctttgtttctttttctatctttaaactaaagataatgcatttttcatacttacacttcttatttttcctcgggtatatttaataaaagggaatgattatacgtacttactttttcttactaaattcttattactaacgctggtgtcataagtgcatctagatttattgtaacttctatctatttaaatcaaacggttgagatgattgttaataaaaaattagtaggttgtgtttagttcacaccaaaattggaaattttgttgaaattggaacaatgtgacggaaaagttagaagtttgtgtgtgtaagaaagttttgatgtgatgaaaaaattgaaagtttaaagaaaaattttggaactaaacacggcctacgtgtagcagtgctctaaataaaattggcacactcgaagtgctggcttattagaaaaataaatatactgaagataacacacatccatcatgtttgtgcagtccctccagcctactacgctcacctggcagcattccgggcgaggtactacgatgagccccccgccatggacggagcttcgtcggtcggcagcggcggcaaccaggcggcggccggcggccagccaccggcggtgcgccgcctcccgcagatcaaggagaacgtcaaggacgtgatgttctactgctgatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgctactcgatagttgtatgtttctcgaagtgtatttttttggggttatgtgtgatgtttgaaagacaggtcatgatctaaattatttctgcggattagttgacatgccatgatctaaa

SEQ ID NO: 909 - DNA, 10463 bp, Oryza sativa
gcttggacgcatctgcatgttcccatagcctcagctttcaccggaagaacggctgctacagccatcgaccgcctctggctcgatcgctgggtggctctcgcagccaagacgatctgatacgatctctttgcagagcgagagagagaggggcgagcagtgatccagtttttcaaacgtgacacgtatgccgatcgaatcgccgatagacgatcacaccatatagtatcgtttttccagtgtaaagttctactcgatcatgattgatcgagttcctctctcaggagtacagagtagctagcttaatagtatatagattatttatcttacccatgattaaaactacctagccattaattaggagtgaagatattttcaccttgggtacaatacagtgtgagaatgacaggtgggcccaagccgtacgagagataattccaaggcgcatgagagagagactggctacagatgcatgcatgggtcattcgttcctccagaatcttcttctttccgtccggtgtgatcgggttgtgacttgtcttggaggtgtggactcatctcatcactcactgcatgcgtccacgtgctttgccttgcacatgtatattcacatctcaattctcaaatatttctaactgcagtaaaaatcaatgttgcctatacgcttcgtcttgaccatcccttcatgaaggtaattagaacacgacttgattttaaatcaaaccttttctacccatagcgatcaaaatggtccaagatagaggcattacgtggcagcaattcgagactcgatcgctgggaaaatgagaatactaggcaacagtaatttcaatcggtaggttttcaaaaaagtaatttcagtctgatccttccagctggtacgcatgcacttctagctagttttttttatgcattattgatctgtatagtatttaatttgtcaaattttggacaatgtatatcacaaaaaccacaccaaacatatataacttcaatattaattacgagaaaacaaaacggaaggatggtgtcaaatgggatactacactagacgtacggccttttttgccatttgcagtttaactttaaacattatgaattgctacactcgtacacttgactatacatatgtataacttcacgttcatagcttggttctatacaatatcttaacacccaaattaataacaaaacaaactcagattaattagttcaccccgatcgatgaacttaatgacatataattttccttcaaaaaacacaaaaaaaaaccggacataaattcactttctataatgacacataatttgtcttgggtagcaagtttgattaaccggccgcctaattaatcactcttccgtacggacaagcatacagtcaccgcgcggtaagatcaccacccccttctccctcccaccgcgtctagctagggtttctcctcgtcgatcaccctccgcctataaaatccccctccccttccattcccgcaaggccgcaacatcactcacccactccccaccccttcccaaaccctcacctccatctcgttgccttcctccacctctctctctgccatggcctaccgcggcggaggccgaggtggccgcggcggcgagcagcggccgccctactccggccgcggcgacgtccctggccgtggtggcggtggtggtgggggtggagccccgccgtaccgtcccgcctcgggcttcgtgtggccgccgccggggatgacgccgcggccggggcctcctcagccgcagtacccgcggccggggccgccggccgtcgtctacggcgcgccgatgccggcggcgcaccaccagggcgcgtaccagcccgggggcgtgtaccgtgcgccctccccgggggttccggtgatcggtggctacgcgcgcagcacgcccgtcaccatccgggcgcctccgccgtcgcactcgtcggctccggctccgtaccagccggcggcggccgcgccggctccctcgtcgtcctccacggcgccgtccgctacggctctggccaaggagttcgagcagaagctgttcgtgtcggagaccgcgctggcgccacccgcggcggtggcgtcggccgcggccgcgccggctggcgaggcgtcggtggagtcggacaaggatctggcaccggtgtcgaagaaggggctcgcccaccctgcgcggccggggttcggagcggccgggaagaaggtgatgatccgcgcgaaccacttcctcgtcaatgtcgccgacaacaacctcttccactacgatgtgagctcacccctgaccctctttcccttcccttcccacccctagatctacgcatactccatgcatgctgtctactactgtactcctgtacgtgtgatggtcagatctgttaaatttaccttgcatgttgtgtgtatgcatggattttgcttgcttctggatgatttttttttgttgtgtcgatggcaagttcgtttctctgctgccttcgtttgcagttttgcatggagcgagggcttccgatctcatcctagtttgtgggtgtttggtcggagagtcgcgtctcctttctggcataaagtttcttctccgtttatttggccttctccacttcggtgctcgctgctagtttggtgctagagatctggccgatgtcgagagggccgcagcacacgcagctcacccgttcgaagcctttcgttctgtttgtttaatttggtgatatgcatgtacatatgtagtacgcgtctcacgtgctcaacgcaccggcgtacatgcatgtcgttgtttagttgggaacgttttacgtttcgtacaagggtaggttgctcggttcagttttgcttcttgatccttctgtttcgttctttcgattgcaagttcgtttctctgctgctttcgtttaaagtttatcatccagttcgtgggtgttggtcggagcgtcgcgtttcgtttcttgcataaagtttcttctccgattttttgatcccctccgtttgtttggccatttacaccttcggtgctcgctgctagtttggtgctagagatctggccgatgtcgacagaaatctcatggccgcagcacacgcagctcaccaattcgaagcgtttcgttgcgttcgttttcgtgacatgcatctcatctgctaaacgcactggcgtacatgcgcgcgcatcccgttttcttcagaacggttgctgtgtttggggttgctgatttcgtacaagggtagttctgatctctccctcgtgggagctggtcgggtttttccctctgcaagcaaaggttttgcatcgttttgttctactttacaagtttgcttttttttgtgtgagttggaagacgacgaaacctctctgtgccctgcccggtcggttctacctctggttttgactgtttcttttgttgtcttttggagactgccatttttgtgtaagcggatacgttcgcttgctattttcttgcaagggacatgttaaacttgttctccctgtatgcgaagccttcgcgtgaacttttgcatccaaagtggtcagatcgattcttgttttcttgtagcagcggactagtgaccgctgtcctttctctgatcttcttgcagcaactctccagcggccggaagcctgtcgcttgcagaagtagagtggtggatccacgtttaaaaactcatgatacatgtggcttttggtttttgtgttttctgctcttttttttggcaaaatatatgaaaattttatcgttgtcttcaggatgtcgttctcattcatgatcttgtacgcctagctttttttttattcgttcaaaaaacaataacgttttttcaggtggaattcttgcaaactcgtttcatatgttttgttttgctttggggcttttagtagtagttccatttcttattttgtttttgggctttgatgtttggtttctgattcctgagctgtaccgatattcttggccctgttcctatgggctttggtgggctttaaagaactcgtagtatagctattcttcatgttcgacccgtagtacagctattcttcaactctccccatgcttctctccccattcctcgaacgcttcgccggcgattccctccaggctctagcgtccgccatggatgcccgccccatgtaagtgtcgtacccgtagtattgcaagtgtagttctacctctatcgtgacctcaatggagaggatcaatctttaccaccttctttgttgtttgatttctgttggtccctagctgatttagatttcgttactttggggcattctgtttttttgttcggcctgcattcatttccctaatcaatcggctcggataatgtgtgtactactcataacttggtgctgaattactcatttaggtctagacgaaatacacattgagtagtttggtgtattagtgatggttaactgctctgatctaaactacttgttacgtgatgtttactgtagagttcttgttaagttgctctaagatcttcctttttataaaaaaaaaatctgcccctcatgtccaatagaaaggccgttgatcttctttttggattatgttacaggtttcaatcaatcctgagtcaaaatcaagagcaacaaatagggaagtactcaatgagctcatcaagttgcacgggaagacatctcttggtggcaaattgcctgcctatgatggaagaaagagtctctatactgctggttcactcccttttgaatcggaggagtttgtggttaagctaattgatcccgaaaagaaggataaagaaaggtttgtatgatgcaaactagagatttaaattcttatgaattatgtgttttgcagtctcatattattttttctttcttgtcttctgcagggcggagagggagtacaagatcacaattcggattgctggcagaacagacttgtaccacctccagcagtttttgcttggaagacagagggatatgccccaagaaaccattcaagttcttgatgttgtccttagggagtcaccatcttggaagtatgattctttcttgtctttgttttgacttttgcttgattatttactgactagggtacaaataatgcattgataactactttttctgcagttatgtcacagtgtccagatccttcttctctacccagtttggtcaccggggtgacattggtgagggacttgagtgttggagaggttactatcagagcctgcgcccaacacagatgggcctttcgctgaatataggtacttccctgtcagttactgtttatcagttttctctgaatggaagtgatcttttcagatactaactactgttcggtatgcttcattcagatatatctgcaacgtccttttttaagcctgtgacagtgatccaatttgtggaggagttcctgaacatacgtgacacctcaagacctttgtcagaccgggatcgtgtgaaggtaatattcctactgatggaattcataaaatcatgcaatactgatcctaactcatttttcatgatgtttagataaagaaagcattacgtggggttcgcattgaaacaaaccaccaagaggaccaaatcagaagatacaagataacagggattacccccattcctatgagccagctgatgtacttatctttcctctgcttctgctataactctctttttgtttacattctttaagatacagaaaatcaatatagattgttgatggaatatttgaaatgtctttgtttatggatcttgggcatggtaagtacattaattgtttgtggacatgtgatagaaacattttaatccttttcaaaggtttattccttagatatcaatgtatgttcctttgatatccatactgtcaatgctgtgaaatgtccttcaatgttcaacaaaattgatgtgtaaaggttgaagtgcacataattttactgtcctgagaatagtgctttgtcatcttttttaggacctgcattttgttatcatgcttgttcactgttttatagcatgaacataacttgtttttcaccaaactgatgcctggtttgatgttgttagatttcctgttgatgataatgggacaaggaagactgttgttcagtacttctgggataggtacaattacagactgaagtacgcttcttggccctgcctacagtctggcagtgattctcgccctgtatacttacctatggaggtattgattcatcatccatttacctctacctgaattgtgcatgctgtgtgcagtttgttcatgcaaatgtgtttgcaggtgtgcaagattgtagaagggcagaggtactccaagaagcttaatgacaaacaagtgaccaacatccttagagcaacctgtcaacgcccccagcagagggaacagagcattcatgaggtacaataccatgtagatgcagagccaaactttttatgcttttggatttttgctcacatttaatggccttttatttctgcacattttattagaataacatttccgtagaacataaggctatatttttttcttgatgagataatgaagacaatatcatgtatttgtattgacttccatttcatcttctatcagatggttctccacaacaagtatacagaggataggtttgctcaggagttcggtatcaaggtctgcaatgacctagtctctgttccagcccgtgtgctgcctccacccatggtactatgctttattccatttcttttgttcgcattgtttaaactgctgggaatttctaacaaccttaatctttgcgcttttcagttgaagtatcatgattctggaagggagaaaacttgtgcacccagtgttggacagtggaacatgattaacaaggtgatgccttgctttattattacaactcaatttctctctcaggttaattttgtattgcctttgtttgaaagtgaattctaggtacacttgcttaacttctttatgaattgaccattagcattattttttgttggagagtatctgaaattgacaaccttgtactgaaacataattgcagaacctgtaaagatacaaactactgagccaacataatttacttgctgatgtgtttaaaggaagacactaatacttgttaattttttcagaaaatgatcaatggaggaactgtggataactggacatgtctgagtttttcacgaatgcgtcctgaggaggtacaaaggttctgtggtgacctgattcagatgtgcaatgccactggaatggtaactctggcatagttacaatgctattaaagcagtttaataattatatgtgctgcaattaactttgacttgaccctgtagtctttcaatccaagaccagtcgtggatgtccggtcaacaaatcctaacaatatagagaatgctctgagggatgttcacaggagaacatcagaactgctagccagagagggaaagggaggcctgcagcttttaattgtaattctgcctgaagttagtggttcttatggtatgtatattgttggttgggtaacttttccattccctgatttatttattaaatgtcgtatatgcatggtttttacagggaaaattaaaagggtctgtgagactgaccttggcattgtatctcaatgttgtttgccaaggcatgccagcaggccgaacaagcaatatttggaaaatgttgcactcaaaatcaatgtcaaggtctgtaattctgctgggcttgtatttttttccctagaactataccaattctgtggactatatcttgtgtgcttttagtattctcccccagaagtatgacaattctgtgccataaccaggtcggagggcgcaacactgttcttgagcgagcctttatccgcaatggcataccatttgtgtcagaagtcccaacaatcatctttggcgctgatgtcacacaccctccacctggagaggactctgcatcatctattgctgcggttagtaccctcctagctaatggttcttcaattcattacttggtctgtttgatgttgtcctacaatacaagatcatgggctatcctgtgaataacttgatgcaatagatgaactatatttttcttcccaaagtttattgctttgcatatacaaactttactggtatattttctttgtgttcatgtaggttgtggcatctatggattggcctgaaatcaccaaataccgaggtctggtctctgctcaaccacatagacaggagataatagaagatctctttagtgttggtaaagatccagtgaaggttgtaaatggtgggatgatcaggtaaatttgtggtcaatgtggtattgcaattgtatattattgtaggttcaactgggaactgaccatgctcttgtttacagggagttgcttatcgcattccgcaagaagactggcagaaggcctgagaggataatcttctataggtatgtcctggaaattctgttctgttcagtggtgtgtccagttaaatgaaatttgttgagtggtcattctcctctgcagagatggtgtaagtgaaggtcagttcagccatgtgcttcttcatgaaatggatgccatcagaaaggtgagcttcgcatcatgatacatctgtctgtgttatctattctggacaagccaatttcattgttttttctgaatttaatccttttacattgcaaggcttgtgcatctttggaggagggatatctaccacctgtcacatttgtagtagttcagaaaaggcatcacacaaggcttttcccagaggttcatgggaggcgagacatgactgacaagagcggaaacatccttcctggtcagtttcttgttggttgctactgagaacatacatctgctacttcttcaggcatttgatgattggatatatcgttgtattccgtttctttttggtcctgcaggaactgtcgtggaccgtcagatttgccatcctacagagttcgatttctacctgtgtagccatgctggcatacaggtaaaacccatgctggaagctgtttgcagattgcacaaaattttccagccaacaaaattttcagttaatgtgtgctcttgacattccttttctcagggtactagcaggccaactcattaccatgtcctttacgatgagaaccattttacagccgatgcacttcagtccctgaccaacaatctttgctatacgtaagttcatttctctgtttctgcttagttgcttagctcccttattatttcggctgccccaactctgataattcctactgttggcaaaatgcagctatgcgcgatgcacccgggcagtgtctgtgggtgagtcttcttttcttgcatctttgtttctcatttctgcattagtttgcttagctttgtttacctccttcgatgagcaagcaaatgtgtacaccaaaatttttggcattggtttaactgtgaactggaaaagataagcgctaggagtaggctgttgttctcaacagtagaaatccttatttagcttgtgttaaaaattggacctttgtttactgtaatgcacccaattcatcatgtggtaagggaactgcacagctgtcattgcttgttatgcaccaccaatgtcatcttgttaactgttccacaacatctgcttttcaaaattgtcctcagcattttcttttcgaatgtgttccatttgtatcttatcattttgtatgtgatgctcccatgttactttctggaactagcaattgaactaccgaaacattttcctttctattcactgatgtagtactcattttcctatctgtgcaatttagcatgttttgaaattgtgtttttgccaggtcggcgaaggagccgaccaaatttcattaagattgaaattgtgtctgtctactgtatgtaatgcacatcatgtgatcttgctttttgaagtgaatcgaacctagtgttatttgcttgtcaagcaccatcaatgtcatcatgttaactgttcctaaacatgtggttttcaaatctgctgaatcctatcatttcgcatgcgatgctctcatgctactttctaggcactagcaattgaactacagagattcttttctacgtggtgctccttttcaaatctgttgcatttgttcactgatgtattgctctttttctttcctgtgcagtcccaccggcctactatgctcatcttgctgcattccgcgctcgctactacgtggaaggagagagttcggatggtggctcgacccctggcagcagcgggcaggctgtggcgcgagagggccctgtggaggtgcgccagcttcccaagatcaaggagaacgtcaaggacgtcatgttctactgctgaggagattgttggcaaggagagcccaatattctggtagttttttggttggtagacttgtttgtgtccttggtttggagctggttgcttgtagttccatttgctgtttccgagtagccggattgtgactgagcttttgtggtctttaaggccttaactctgcttgagacaatgcaagtcttttaaatttccctgtggcttttgtta

SEQ ID NO: 910 - DNA, 7918 bp, Oryza sativa
aagcgccgtgttgcctctgaccgcgccacgcgaatgctccgctttgtccctcgacgccacgccacgcgagtagcgccacgcaccgcccaccaccccatccatccatccatcgggccgtgcgccgtggttggcggcgttttttcttggtaggttttgtattgtacgcacgcactggtagtggacggctagtagcctagaactggtgtaagtcgttaacccgtaaaacctacttaacctgtttggattcgtggccgaccaattacacccctacctaaaactaagatcggtgctgctgctgcttttgcccgtgcgcgcacgagtaaaaaatgggtttgggccatgagggaacgagggggtgtgtgtgttgtgttcttctattctgcaatggtggagcgccttcttgtcgggggcacgcacgcttccaaagttgtaccgcacgggcaccgaggggcagggcagggcaggttctctcggctttgggacatttcttgctgcgtcgctggtggtgtagcagtggtggtagtgggagtagtggcgttcaaggccaaaggatgttgcgtttcgatttctctagtgcttgggccatgctgcatgaggcttaaactaaactttgatcacactttggatgcatgttcctgcacaacaccaaaaataaaaaaaaaataaaaatcctccaaaaatagcgcttggtaggatgtccgtcatgccagcaatacgcagttgaatcagacttaagtgcctgtcagcattgaacaaagttttgtaatgtcaaaagttccattattatacacacaatctgcctctcaatgatatttacaagtactactagtactagtactcccatggtaacataacaccacgcgctagcggccagccacacgaacatgtgatacacttctcaataaaaatccccatccattctcccttccttccatccccttcgataatccacccccatccgttggaaacctcagctgcactaccctctcgtgtttctcgcgccccaattaatccacgggccacaacgttttacctaccgtctccccccacctacaagaaatcatttctacgacgcctgctacctttggtaaaaaaaacggagcatattttgcttcttccctgttcaatcttaccaccggcaggcaaggcgaggtctatttatttatttaccgcgcgaggcggccactactactactaggaccaaacagggtcaaagcagctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcgaggtggtggtggtgcgcacatgctcgaggtgctggacatggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtaagtctctctctctctctctgctccatatgtactttgagcatggaagaaaggtgagagcggttttcttggtttccgtggcgcggcggcggcggactttgcaggtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacggtgcgcgcattatttgcccacagcccggcgctccattcttctccggccatgtcttaaccgtcatcgcgtctctggctccgcagggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtacgcacacgcattgctcgtcgtcttgtgttcttgcaagggaaaagaaaggaaaaaaactaatactgattggccccaatggtaggtatgtctcgatagggcggtcgttctactcgccggacataaggaagccgcagcggctcggcgatggcctacagtcatggtgtgggttctaccagagcatccggccgactcagatggggttgtcgcttaacattggtgagatgctcgcgaatatttggtgccctcatgcatgtatctttcctggttgtcatgtgcttgctgcttacatggtggatgatgttgatgccagatatgtcatctaccgcgttcatcgagccgctaccagtgatcgaattcgtggcccaaatactagggaaggatgtcatatcgaggccattgtcggatgcaaacagaatcaaggtaaatttatgcttgcggggaaggaatagtctagccttgttactgtagtgggatgtaagatgtgttgtttggatgcttttggttaactgatagatggcttaattgtgatgctttgcatgattatctgatttacctgtggaattcgccaattccatgcagatcaagaaagccttgcggggcgtgaaagttgaagtcactcaccggggaaatgtgaggcggaagtatcgcatttcagggctgacaacacaaccaactcatgaactgatgtatgttatagtgtaattcatttctcgtcatgtactttcaattgtcaaatgtcttgtaccgaactttcacgaaagtagaagcatgcatgttaagcactccctcttgcttctaaatctgagtatggcagaccaaatagaccaaattaactatcaatatccatatttcatatacgttagctactaggcattgtgttaagctatggaactgattttgtttgttttaacagtttcccaatcgatgaccaaatgaacatgaaatctgtcgtagagtatttcaaggaaatgtatggcttcaccattcagcatccccatcttccctgccttcaggtgggaaaccaaaagaaggcaaactatctaccaatggaggttggtattaatctcatcaagtcacaaatttcattagctggtcaattatgtaacattcaaccttggtaaaagacatcatcattttgagatatttcttaccaggcctgtaagattgttgagggtcagagatatacaaagaggttgaatgaaaagcagatcacatcattactcaaggttacttgccgtaggcctagagaacaggagatggatattctacaggtctagttttttctcctaatcggattataacattttgaaatatatggattacatgtttgtcaggagtaaatgtttcaagtattttgtcttactaaattggatgataaatccaaacaccaaatcagtgcattagaatttagaagatacgcatgctaatgtacgttaattgttctatgctgaagtctttgttttcattacccacttccaagtggtccaagcattccatgcaattgatgttcaatagctacccacccaataagtgctactagggtttctcttcacttgatcagcactcttgttataatggttcaagactaaaaaaatttctttccagacagttcaacaaaatggatatgagcaagacccttatgcaaaagaatttggaatcaacattagtgagaagctaacctcagttgaagctcgggtccttcctgcaccttgggtatgatttgcctttgttaatctcagtagttggctaactgctctcagctaataatttgggtatgaaattttgtggctttcagctgaaatatcatgatactgggaaggaaaaggagtgcttgccacaagttggtcagtggaacatggtgaacaaggttagattccccgttttccgcagctgtatacaacagacgtccttttatatatcatgatgatggcctgatcctgctagttttccactaattaagcattttttttttgcagaaagtgataaatgggtgcaaggtgaatcattgggcttgtataaatttctcaaggagtgtgcaagaaactactgctcggggattctgccaggagttggcacaaatgtgtcagatatccggcatggtatataactcttaacttcatctaatggttttgcataatattggtgcttttataatgttatttgttggctgcatcttttcagttttatctctgctcttcttgcaggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgagtgtcggtttggtaattgcatcgcaatttttccttggaatcctcatattgtgtgaaatgcttaagatgtaacttaatatttgcaggtgatataaaacgtatatgtgaaactgacttggggttgatatcacaatgttgcttaaccaaacatgttttcaagatcagcaagcagtacctggcaaatgtctcacttaaaatcaatgttaaggtaccaaatacttataaaccaagcagttaatacttagcttgtctacacaaatgtagtgtaatgcagtaagcagacttgcagcattgctaatgccttgcatttcggagttgtgatacagatgggaggaagaaacaccgtgctgctggatgcaataagttggaggattcctttggtcagtgacataccaactattatatttggtgcagatgtcacgcatcctgaaaccggggaggactctagcccatccattgctgctgtaaggctgagcatttctatggttacatggccatcattttttttttaacctcttaccctctctaataagctgcatgcaggttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcaggtcttttttgaggaacaatttgttcttccaaccaaaattaattgatgaagcctcctattaaatagtttagggttacctcctaccgattaacttatttttggttctggtcttgttgtgtagggagctcttaatatccttcaggaaggccactgggcaaaagccattgagaataattttctacaggtatgctactgcaaatactgtttataaactaacgtttgtagagtacagtagttagatatttgtggaatcaatttaatcctatgtatcttcaacaagtactgaacctagtgtttttgttcgctatttgaagtatgaaagttgctgttataggcttctatttgtatatctgctaatagtatcggtactgcttctcttctagggatggtgtcagtgaaggccaattctaccaagttctcctctatgagttggatgctatccgcaaggttagatgcatttgtattttctttactcagatattttgtccactttattaggttgcctgacgaaatgttttcttttaggcatgtgcatctctagaaccaaattatcagcctcctgtaacattcgtggttgtccaaaagcgtcaccatacaagactcttcgcaaacaatcacaaagacagaagtagcacggacaaaagtggaaacattttgcctggtaattactattcatcacctcttaaggcatttcattggatctactgcagatgataatgcaaccaacatattgcaaaaatattttttttattttaactaaaaccctcagtttgttggtagaactgtttcagtgatttgatacttgttttcctattcatgatatcacattcacaactgtttttcttggattattaaggtatcactttgggtgaactaacttttatatttactgttattcacttgatttctgtaattgctcatgtgtttgctaaaaaacaggaactgttgttgattcaaagatctgccacccatcagagtttgatttctacctctgtagccatgctggaattcaggtaagaatattgtagtggtccttttgtaaggctgacatatactgaacttgtcgttactctggtccccatgtcttctgtgattaagtatttgaggagacttcatattgtcttttcaaccacaagcagtgtagtacttcctccgtcccaaaatgtaagcatttttgaggttggtacgggtattaagaaagtaggtgagaatgattgaagaaggtgtgtgattgattgaaaagagaaagtaggtgaaaaagaatgattgtgattggttgagaggagaaggtaggtagaaaaatagcttcattttgagacaaattactgtgctagaaatagctacattttgagacagaggtagtagtatcacagtagctagttactgtagtacctagcaaagggcacatctgcacatgctagaacaaacaaacttactataccatggtcaaatttttaatcatgtgattgtacattatagtacttggatcagcaaatattctgtctgtagtagcgctggaatataattccccaagtttgtcctccatgtactgaaatgactgatgtgtgtgagttttccagggaacaagtaggccagctcactaccacgtcctttgggatgagaacaatttcactgcagacgaaatgcagacattgacaaacaacctttgctacacgtacggcattactgaatcttgttaagtttatcctttgcactctgagcttctctctatagaaattgtctgacttggtacatttgctgatgcagttatgcacggtgcacacgctctgtttctgttggtacgttcttctgaaatgatctgaacatttttccatcattttctttgtattcatgtgttattattagttggacacgaattctgaaggtgaatcttgcatttcttttttcctggtccaacagttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcagagcaagcatttggatcctgagcgacctcttttgaccactctgtaaagtactaagtaacgcatgtataatagttgttgtatcagtctgaaaaaaaggaagtgcactcagtgcttgtttttccagttctaggatgattttctcttcatggttaagatctggtaagagactc

SEQ ID NO: 911 - DNA, 7397 bp, Oryza sativa
gtcctcgaatccctctgctcactaccgtcgcgctcgcttatattgcgggagtcggcgacgaaaaccaccgagcacccgtcggcgcagcagcggcggagcgaagggaagggaagggaagccgcgatccagccgccgtcgactcgccgcccacgcagtcgccgccgagccccatctccgccactgctcggtgcgtgcgatcgttcgctttactagctgtactagcgctctagagtgctgtgctttccccagtttggcgtcggtgctcggcgaacctgtgtgttcgatcggatgcgtattatgtgcgggcgatttagtgttgatgtgtcgggtttttttttatactcttgggtttttcggtggtgttcgttggtggggggaatatgaagggttttgagggaggttttagtggaggatgtgaatttgagatcgattcggttgttgtcatgctcttttacactttttggtggttggggggtggaattggcaagcgtggagaagggcaggtggtggagaagatgaggaagtctggtaatgtacgttcatgatgtgtttttgtggaaattgtgctcgtctaatttgatcgatccttttagtttttttctccatgcttctgtcactgcattgcatgataatttggcttttgaaaggggggaaaaaggaatgctctaattttggggaatcaagaacatgtggtaaatatgtatagtccagagtatagaaatggatagatgatagggatacccagggcggagccaggattttgagccactgggtcatggcttttacttgtactaatgtcgtgtttaaaactctaattgttctcgaagctagatatctttagatcaaaattattttggagctagagcaatgaggaagttgggatcgtttcattttgttaaaaataaatgtttaaactctatattttataattattttataagaatgcaggaggttttttaaggtccaaaaatttaaaagttaagactataaaaccaggcataacaaccatgcgttttttcagacataaaagtttgttctgaaagttgtttattacttcctctatctcaaaatacaactacctactctcttttttaaaagattaatgttagggtgtgaaatagttatgattggttgaaaaaagaaagtaggtgaaaaaattgaattgggaaaattgtgattggttgagatggaacggtacatagaaaattagttgtattttaagataattttgaacattaaatgtaacatattttgagacggagttagtagcttaaaaaacacagctaacatctagtagttgattagcaaaactacaggcctaatgcattgatatacacaacacatagctaaaacaaagagttggttaatggatgaaataggtctaattgccgcattagtagtgggttgacagtagcataacctagctaacaaattgtgcttccaaagaagaagctgtactatttcagctttcatgagctccagtagtttagcgacctgatcggggtcatgaagcttttgctgctggggtcattagctgcaaaatcctgcacgattcacttgatcgattgaataccatcggggtcacctgaccctgacgatattactgcagctccgcccttggggatacctgatttacaaaaaggaatctggcatgtgcaatagttagtatcagggaatagtttacaaaggaagcatggagatggttcgcatgatcattgttttgcttgtattctttgatacattacagtaccttgtttacttcactactttaagattatgatagaaacaggataaaatttagcttttaagttctttctgtagacgatacttaccattctgccgtaaatctaaagagctgtgcgtaattcttaacaataattgtttatattgatgagttcctgcagttgtgatatgcgccatgggtgtcaagactttacaggtatcagggtttgctctagatgacagtgctgattacgtcaaggatttgttggagcgaattgttggctgtgggaatgtgtatgcagtaaagctcaggcatccaaagaacgtcactgctacctcaagagcatatgctatagttcagtttcagaccgaggaacatgcttcacttgtaaaaaatgcggctcaaagaaagatactccgccgtgggcattattatctgaaagtccatccttcagatcgtgacattgttccaagaccaagagtttcaatgttcaagctagaggatgtaacactgcattttggttgcctgcttaaggaaacaattttatctgctctgtggagtcgaaaaggagtttctgttgagtttggtttcaatctgaaaaagatttacttttacctgcagctacccaacagctcaatcgaatataaacttgaactttcccatgagagcatatgggagatccagcttcaacgcccacccaagtcacaaacgaagtttcttttgatccaggtatcttgagctctacagcacttgctgatttcttttcagtaaattgtacaattattgtatgaccacatgttcacattgactaatcttgctgttgagatagtttctttagtaaatattaaagtggttcgcctgtactgtgttttgttctgctattaaggcttgacgaagaacggtttagtcacaacagttcatggtgatgacttttggaattttggtcaatggtgattttgctgttttcggaaggtgaaagttacatgggagttctgttagaatgtatgtatcatatggtccttatttgatatacaaatggacaatgttaatgtgtttaggagcttactgtgatggtttaaaagaatcatttgaatttcttctgttagtattcttgttcccctacctgctttgctgtggctcacaacctgcactttagcatggttgaacgacattatactgttcaatcataaattactggataatgaaattgcatttctaatctttgtgtttctttaattcttcatgctaatgaatttatgagtgctctctaactcgcctgtccctttcatttcaaaatatgcggcaatgaagttgtataaagatatgctacttgagtattacttatctggagtgaaaatatgatcgtgttcttatgtaaaaaaaaatatgatcatgctgaagcactgaattcttttatccagtattttcctttatatttccacttcaaaatgttgatccaccccagtcaccaattctagttgttatctcttgatttaaagtttagataaccttaaatttataaatcgtttcatgtttcaggttcaagctgcacctaagatttatgaacagacaccacgccgttctggtgttatgtacgaagatccattattcaactattttagggatcatacagatgatcaatggaccaggacaacggattttacttcatcttctagcattgggcaatcatatattttatgtcttgaggtaccacgtcgatgtgatctcccaaacattcgtgactacttcttttactatcatgagtacaatcatgacttcgagtgccggagtggggggtatccatattcaagtgatactcgctttgttccgattgtgaaatctcgtggttatgtcccctatgagatactcttcaagatcaaccatttggttcagaatgggacacttagcggaccgacagttgatgacagcttctttcgtctggtcagcccagcttttgtacctattgaccatataaagcgtgcacttgaaatgatgtcatatttgaaaaagacctgcttgaatccaacaagttggctatctgaacaatactcaaaattccggagatcacgctacgtccaaccatcacctaacatatctctggatgatggattggtttatgtctacagtgtatttttatggacctgagattaatgtctccaatcgtgtggtgcggaatttttcttctgacatagagaatttccttcgcatttcatttgttgacgaggactgcgagaagctccgtgcaactgatttatccccccgttctgcttcaggacatgatgcaaacagaactgctctgtataagagagttctgtcagtcctttcagatggcatcactattggtggcaagaactttgagtttcttgctttttcttcaagccagctccgagataactctgcatggatgtttgcttctcgccagggattagctgctagcgacattaggacatggatgggggatttccgtaacatcagaaatgtagcaaaatatgctgcaagacttggtcagtcttttagttcctcaaccgaaacattaaaggttcagaagtatgaggtggaagaaatctcagatataaaaaatggtacacagcatgtgttctctgatgggattggaaagatatcatctgcttttgctaatgaagtggccatgaagtgcaacctgaaacgctttgctccttctgcttttcaaataaggtatggtggttataaaggtgttgttgctgttgaccctacatcacgctggaagctttccttaagaaaaagcatgctaaagtttcagtcagacaatatcacagtagatgtccttgcatacagcaagtaccagccaggcttccttaatcggcagctaattactcttctttcgacacttggagttagagatagtgtctttgaacagaagcaagaagaagcagtgaatcagttgaacaaaatggttactgatcctcaagctgctatcgaagcaattgaacttatgcccatgggagaaataacaaatgcagttaaagagctgttgttgtgtggctaccagcctgatgatgaaccatatctttctatgctgctacaaacttttagggcatccaaattactagagctgaaaaccaagtcaaggatattaatcccaaaaggacgagcaatgatgggatgcttggatgaaacacgtacgctgaagtatgggcaagtgttcattcgagctacttcgggtgtaaatgacaatgacaggttcaccgtgacaggaaaagttgtgattgccaaaaacccttgcctccacccaggtgatatacggattctccatgctgttgatgttcctgttttgcaccacatgtttaactgtgtcgtctttccacagcaaggaccaaggcaagtattacatactcctatgttttctagtagtatgcttttttctgcaaaaccccacttttctggaaacaaattctgtctgggtttcacattttaatgaaaccacatattcattggagaaaagcttattctccaatttcatatattttaggttgaagaacttcgttgtttgtgaagcttagccacctgcgatttcatggatatgcgatatttgatcctttttttttcttgttaaattcccatgcatgcatgttcttgtctgttcgattttgttatctacatttggttttaaatatatgccaccattgactttgttaagtaaagtgcaaagagtaccactagatttgtcatatttgtctgttgtacaaatatttatagagaagacaaatagtcaaatgaaataaaaagtcaatggtgccatatttaaaacatgaggcagtaattattttgaacatgattgtttgtgcaggccgcatcctaatgagtgttcagggagtgatcttgacggggacatatattttgtttcttgggacccatctctcattccgcctcgtatggtgacacctatggactatactccagcaccaacagaaacattagaccatgatgttacaattgaggtaagctcagttttcaaccagaattgtccactctttcttgccactcatgctagcaattttattcaattgttggctggctagtgttatgctgttctttggactcacgagtccagctcttgtattttttaagattatcatttactcctattttctggcactgcaagatttgggtatatttatttgcaggaggaaacaaactaatcctagtgcacagcatatatggtttttattcaaaatccttcatttaataatattacacatctatttccctattttctgtaataaatcttgaatattagaaggaagatatgctgcctctttcttgttagaatatttaacttctagagatacgtttgtaattggtgcctcataatgaggatactactgtcaactgagagaatttgtcttaagctagttgttttttttgtttccctggttatcttgtgtaaacacgtactgtgctcacttataagagtagcaaattctgtgttctttttttttttgaaaaaaaaatgtatttggaaaccatgcagtctgattcaagtctaggggtagtctgcatttggttggacagttgctgttcaaattgataatactattatgttgcctgttggaataaaattattaccagcttcatgtttctgaatttgtctacatagcagtcacttgtttttcttgcaataaaacagcacggaaatcacataattaagaaaataaatgtcataaatttatctttgttagaactgagttttagcaaatcttatacactgccctgtaacttcattattgcaccatgcaggaagtagaagagtacttcacaaattacatagtcaatgagagtttaggaatgattgccaatgcacatgtagtatttgcggataaggaagacctcaaggcagagagttcaccatgcattgagctggccaagctcttctccattgctgttgactttcccaaaactggagtgccagccctgattcctcctgaactacatgtgaaggagtatcctgatttcatggagaagcttgacaaagtcacctatgaatcaaaaggagtaatcgggaagctctacagggaaataaagaagcacacccctcacataaagcacttcacaagggaggtggcaaggcggtcttatgacaccgatatgattgttgatggctatgaagattacatcactgaagctatggcattgaaggacgagtacgacttcaaattgggtaatcttatggatcactatggaataaaaagtgaggccgagataataagtggatgcattcttaagatggcaaagaatttcacaaagaaaagcgatgctgatgctatcagattggcggtgagatctttgcgtaaggaagcaaggtcaaggttcagtgagatgagcttagatgataatgggcatggccatgatgcctccgaagccaaggcatccgcctggtaccatgtcacttaccaccctgaattctggggttgctacaatgaaggatatgagcgaccacactttatcagctttccatggtgtatctatgagaagcttttgcgcattaagcaaaggaggaagttcgtcaggaagatgcagcccgagttgttctctctccacaacttgagaatttgagtgtggccagcatgtttgctcttatacatatatctgaacttttgcattgaacatgtctattctggtgcttgaatgcttactg

SEQ ID NO: 912 - protein, 911 aa, Oryza sativa
MDAHDGEADELPPPPPVPANVVPIKADDVESEVPANKPAKPKRFPMARPGLGRKGQPIQLLANHYKVSVKSSEEYFFHYNVILKYEDDRPVDGKGVGRKVIDKLQQTYRSELSSKDFAYDGEKSLFTIGALPQVTNEFTVVLEDVSTGKTAANGSPGGNDSPGGSDRKRVRRPYQTKTFKVELCFAAKIPMNAIAQAIKGQESENSQEALRVLDIILRQHSAKQGCLLVRQSFFHNNPNNFVDLGGGVMGCRGFHSSFRGTQSGLSLNIDVSTTMIVKPGPVIDFLLANQKVDHPDRIDWQKAKRALKNLRIRTTPVNSEFKIIGLSDRNCNEQMFSLRQRNGNNGDVDEVEVTVYDYFVKNKGIELRYSGNLPCINVGKPKRPTYFPIELCSLIPLQRYTKALSTLQRSSLVEKSRQKPQERMSVLNDALRHSNYDSDPMLRASGISIAQNFTQVEGRVLQPPKLKAGNGEDIFPRNGRWNFNNKKLIQTCSVDKWAVVNFSARCDVRNLIRDLIRNASAKGIQMAEPFDVFEESPSLRRAPVSRRVDDMFEQIKSKLPGAPKFLLCLLPERKNCEVYGPWKRKCLAEFGIVTQCLAPQRVNDQYLLNLLLKINAKLGGINSLLQIEASPSIPLVSKTPTIILGMDVSHGQPGQSDRPSIAAVVSSRQWPLISKYRASVHTQSPKLEMMSSLFKPRGTEDDGLIRESLIDFYTSSGKRKPDHVIVFRDGVSESQFTQVINIELDQIIEACKFLDEKWSPKFTVIVAQKNHHTKFFQSGSPDNVPPGTVVDKQVCHPRNYDFYMCAHAGMIGTTRPTHYHVLHDEIGFSPDDLQELVHSLSYVYQRSTTAISVVAPICYAHLAAAQVGTFLKFEDMSDASSSQGGHTSVGSVPVPELPRLHEKVRSSMFFC

SEQ ID NO: 913 - protein, 911 aa, Oryza sativa; identical to SEQ ID NO: 912

SEQ ID NO: 914 - protein, 904 aa, Oryza sativa
MESNSGEIEELPPPPPLPPNAEPIKTDDTKKLSKPKRALMARSGCGKKGQPIQLLTNHFKVSLKAADEFFHHYYVNLKYEDDRPVDGKGIGRKVLDKLQQTYASELANKDFAYDGEKSLFTIGALPQVNNEFTVVLEDFNTGKSSANGGSPGNDSPGNDRKRVRRPYQTKTFKVELNFAAKIPMSAIAQALRGQESENTQEAIRVIDIILRQHSAKQGCLLVRQSFFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFTLKQRNGDGEPEGVEVSVYEYFVKNRGIELRYSGDFPCINVGKPKRPTYFPIELCSLVPLQRYTKALSTLQRSSLVEKSRQKPEERMSVLSDVLKRSNYDSEPMLNSCGISIARGFTQVAGRVLQAPKLKAGNGEDLFARNGRWNFNNKRLIKASSIEKWAVVNFSARCNIRDLVRDIIKCGGMKGIKVEDPFDVIEEDPSMRRAPAARRVDGMIDKMQKKLPGQPKFLLCVLAERKNSDIYGPWKRKCLAEFGIITQCVAPTRVNDQYITNVLLKINAKLGGLNSLLQIETSPSIPLVSKVPTIILGMDVSHGSPGQSDIPSIAAVVSSREWPLVSKYRASVRSQSPKLEMIDGLFKPQGAQEDDGLIRELLVDFYTSTGKRKPDQVIIFRDGVSESQFTQVLNIELDQIIEACKFLDENWSPKFTLIVAQKNHHTKFFVPGSQNNVPPGTVVDNAVCHPRNNDFYMCAHAGMIGTTRPTHYHILHDEIGFSADDLQELVHSLSYVYQRSTTAISVVAPICYAHLAAAQVSQFIKFDEMSETSSSHGGHTSAGSAPVPELPRLHNKVRSSMFFC

SEQ ID NO: 915 - protein, 904 aa, Oryza sativa; identical to SEQ ID NO: 914

SEQ ID NO: 916 - protein, 904 aa, Oryza sativa; identical to SEQ ID NO: 914

SEQ ID NO: 917 - protein, 904 aa, Oryza sativa; identical to SEQ ID NO: 914

SEQ ID NO: 918 - protein, 363 aa, Oryza sativa
MFEKVKANLPGPPEFLLCVLPERKNCDLYGPWKKKNLHEMGIITQCIVPSVKMNDQYYTNVLLKINAKLGGMNSKLSLEHRHMIPIVNQTPTLILGMDVSHGSPGRADVPSIAAVVGSRCWPLISRYRASVRTQSPKVEMIDSLFKPLDDGKDDGIIRELLLDFYKTSQQRKPKQIIIFRDGVSESQFSQVLNVELNQIIKAYQYMDQGPIPKFTVIIAQKNHHTKLFQENTPDNVPPGTVVDSGIVHPRQYDFYMYAHAGPIGTSRPTHYHVLLDEIGFLPDDVQKLVLSLSYVYQRSTTAISVVAPICYAHLAAAQMGQFMKFEEFAETSSGSGGVPSSSGAVVPELPRLHADVCSSMFFC

SEQ ID NO: 919 - protein, 1787 aa, Oryza sativa
MVPEPAPAAATEPRRSTRRRLMTAAAMEAEAEAVADLDEIDREMSRAESRKRQRRTAKEKPGARKGATEWKPEDVEKAAAAEGVAELDEIDREMPRPELRKRQRRTAKEKPSAHEGATEWKPEDVEKAAAQEPEGTELDSGLSPAESRGKRQRGVEKVKRRTRKKTAKEKTKETTEKSAAQAPEKMKVNDAGGALAEDVCADEPDAEQMAMEEEEEAADVLEAEERMGKCVGEGSAEKAATRKRVARPSTARRVEDSDDHFVGDPVPDDEARQRWPVRYSRKGSDSLLKQEPDEDEEMKARCHYLAANVDDEIYHLDDDVYVKAGPDEENYIGRITEFFEGVDRGSYFSCQWFFRTADTVISSKLLKVHDHRHNHKRVFLSKEKNDNLIECIVSKVKIAHVDPNMTPQARAHAISDCDLYYDMSYSVAYSTFANLPADNDGALGSEATSNISCDDADNSSKGKLSADIVAPYSEQTETASLLDLYSGCGAMSTGLCLGFAFSGINLETRWAVDINKYACACLKHNHPYSQVRNEKTEDFLALIQQWDALCRKYVVHKNDTLEPSIDMPLNDADDVNEPLPEDIFDVEELLEICYGDPSNTGKNGLWFKVRWKGYDPSYDTWEPIDGLSDCPERIKEFVEKGHKENILPLPGAVDVICGGPPCQGISGFNRFRKHNDPLEDEKNKQLVVFMDIVKYLRPKYVLMENVVDILKFADGFLGRYAMSCLVAMNYQARLGMMAAGYYGLPQFRMRAFLWGALPSMVLPKFPLPTHDAVVRGIVPTTFSQSVVAYNEVDTRCLRKALLLADAISDLPKVGNDQPKDVIEYSVAPKTEFQRYIRNNRKDIQDYSFRGDDPSEEGKLFDHQPLKLNKDDYERVQRIPVKKGANFRDLKGVIVGPDNTVRLDPNISRERLSSGKPLVPDYAISFVKGKSTKPFGRLWWDETVPTVVTRAEPHNQIILHPSQDRVLTIRENARLQGFPDYYRLIGPLKEKYIQVGNAVAIPVARALGYALGLAYRGESDGDRAVLKLPESFIYADQETVVKSSAGTPGSEIADSEQLFEYFINPNFFCMMFAFLKVNVVIPLILDSKMGLSRRGAEEGEARRAVPFQNILSWEGWNRLDHRRGEIRLDVRREMDDSPLDNLFDGNGLDSSAGADSSSSTGSPPSSTSSSPPSSQSPPPGSSPPPASPPPSTPSAPPTNSSGSAPSPPSPSQSAPPANTGGGGSPPPSHGSPPAPKAVQSQPAPKRSGDGGSSSDSGSSKEGGSSSDRGKSESNGNRPGPEAAIIAGMVIGFFTFALLLAIVACVCCSKKKKRPPHMHMPYYTDENGKVYYANSMPRWQNSVDQGGGWHAQYSPGQAPPSSEMSGSHGAGPLPPPSPGMALGFSKSSFSYDELALATGGFSSANLLGQGGFGYVYRGVLAGSGKEVAVKQLKAGSGQGEREFQAEVEIISRVHHRHLVSLVGYCIAGSSQRLLVYEFVPNDTLEHHLHGLHIFPALFPAIVTRHSEGRAGDGLDDEARHRARLSQGPRVPSRRFLQGQILSVRPSNDLICCIVVVTYEGHPRIIHRDIKAANILLDENFDAKVADFGLAKLTTDTNTHVSTRVMGTFGYLAPEYASSGKLTDKSDVFSFGVMLLELITGRRPVDPTNYMEDSLVDWARPLLARALSEDGSFDELIDQRLENKFDRLEMERMAACAAAAVRHSAKRRPKMKQIVRALEGDASLDDLNEGVKPGQSMMFSTGSEYDSGNYASDINRLRKVAFESSIEDSSEYGTHSSADSGEPPRRQQHR

SEQ ID NO: 920 - protein, 1458 aa, Oryza sativa
MADDEAAVLPPPPPLPPPCRPHRQLRPRGSRPTADTTPRTSQLVEVFEAALRGNTIAVLDTGSGKTMVAVMLAREHARRVRAGEAPRRIVVFLAPTVHLVHQQFEVIREYTDLDVMMCSGASRVGEWGADHWKEEVGRNEIVVMTPQILLDALRHAFLTMSAVSLLIFDECHRACGSHPYARIMKIYIVEDRNELESFSPPTTIVNKYYDAYMVDFDNLKSKLQIFSDEFDSLLVGLQESPSNKFKDTDNILETSRKSLSRYHGKILYSLNDLGPIITSEVVKIHIESVKPLCDSEDCIFSKASLCLHMSYFKEALSLIEEILPQGYGELMKSESGSEELTKRGYISSKVNTLINIFKSFGSSNEVLCLIFVDRIITAKAVERFMRGIVNFSCFSISYLTGGSTSKDALSPAVQRFTLDLFRAGKVNLLFTTDVTEEGVDVPNCSCVIRFDLPRTVCSYVQSRGRARRNNSEFILMIERGNLQQQEHIFRMIQTGYYVKNCALYRHPNALSYDLSIQGMYTYQVQSTGATITADCCVNLIRKYCEKLPKDRYFMPKPSFEVTIEDGLFKCTLTLPRNAAFQSIVGPLSSSSNLSKQLVSLEACKKLHQLGELNDHLVPLTEEPMDTDFTTADEKCISGPGTTKRKELHGTTCVLALSGTWIHDSENITLNTYRIDFLCDQEGENYAGFVLLMEPELDDDVAPSKMDLFLIPNKMVYTTVTPRGKVQLNKKQLGKGKLFQEFFFNGIFGRLFHGSRKSGAQRDFIFKKGHEIQWNTESMYLLLPLRDSSYIQDDLSIHWEAIESCAGAVEQLWSSYQGDENVIPVNCIPQKRRGGQEEIIHLANKSLHCSSIKDSVVLSLHTGRIYTVLDLILDTTAEDSFDEMYGSTGKPLLMEKEQIHARVPPELLIHLDILEAITTLRCCETFSLERLELLGDSVLKYVVGCDLFLRYPMKHEGQLSDMRSKAVCNATLHKHGIWRSLQGYVRDNAFDPRRWVAPGQISLRPFPCNCGIETAFVPSHRRYIRDDPSFFVGKPCDRGHRWMCSKTISDCVEALVGAYYVGGGIAAALWVMRWFGIDIKCDMKLLQEVKFNASHLCSLSKINDIEELEAKLKYNFSVKGLLLEAITHPSLQELGVDYCYQRLEFLGDSVLDLLLTRHLYATHTDVDPGELTDLRSALVSNENFAQAVVRNNIHSHLQHGSGILLEQITEYVRSNLECQGKESEFLQHTTCKVPKVLGDIMESIAGAVFIDTDFNVDMVWEIFEPLLSPLITPDKLALPPYRELLELCSHIGCFLNSKCTSKGEEVIIEMSLQLRDELLVAQGHDRNKKRAKAKAASRILADLKQQQGLSIKQCLSKAKQLDIVTSDLQFDLTSLCFHSKWRKVDLEVRFSSYARFCSGQCQNSNLWNKGSGLLLLWMGRQQQTSIALFRQSPCTYLTQQPLHFKCLERLKIRLRESTW

SEQ ID NO: 921 - protein, 507 aa, Oryza sativa
MQAIGGDASVGNCSASACAPQTLEVDEEEDDTNWDEYDTAGNCDRTPHSDGSGDEDFFQEMSEKDEKMKSLVNMGFPEDEAKMAIDRCLDAPVAVLVDSIYASQEAGNGYSANLSDYEDTEFSSFGGRKKTRFVDGSKKRKRYGSGPSGNQVPFDGSHEEPMPLPNPMVGFSLPNERLRSVHRNLPDQALGPPFFYYENVALAPKGVWTTISRFLYDIQPEFVDSKYFCAAARKRGYIHNLPIENRSPVLPMPPKTISEAFPNTKRWWPSWDPRRQFNCLQTCMASAKLTERIRCALGRFSDVPTPQVQKYVLDECRKWNLVWVGKNKVAPLEPDEMEFLLGYPRNHTRGVSRTERYRALGNSFQVDTVAYHLSVLRDLFPNGMNVLSLFSGIGGAEVALHRLGIHMKTVISVEKSEVNRTILKSWWDQTQTGTLIEIADVRHLTTERIETFIRRFGGFDLVIGGSPCNNLAGSNRHHRDGLEGEHSALFYDYIRILEHVKATMSAV

SEQ ID NO: 922 - protein, 437 aa, Oryza sativa
MRIASSSGILMDANGKANGSAPSALVAYFLGMGFSREMVFRAIKEIGNDNNNTFPHLLQLLPFLSGDTDSEQILELLLTYQILEEEDEEEDVNWDEDDTVDNFDRATYSDGSGDEDFLQEMSEKDEKIKSLVSMGFPEDEAMRAITRCGLDASVDLLVESIYAPASAGNVYFTNLSDYEDTEFSSFGGRKKTKLIDGTKKKRERYRSRPQWNQVPFDGSHEEPMPLPNPMVGFSLPNDGLRSVHRNLPDHALGPPFFYYENVALAPKGVWTTISRFLYDIYPEFVDSKYFCAAARKRGYIHNLPIENRSPVLPIPPKTISEAFPSTKMWWPSWDPRRQFNCLQTYVASAKHTERIRCALGRFGDALPPAVQKSVLEECRKWNLVWVGKNKVATLEPDEMEFLLGYPRNHTRGVSRKRDIELLGIHSKLIQLHTTSLC

SEQ ID NO: 923 - protein, 473 aa, Oryza sativa
MRIASSSGILMDANGKANGSAPSALVAYFLGMGFSREMVFRAIKEIGDTDSEQILELLLTYQAIGSDPSVGNSSHSACDPQILEEEDEEEDVNWDEDDTVDNFDRATYSDGSGDEDFLQEMSEKDEKIKSLVSMGFPEDEDTEFSSFGGRKKTKLIDGSKKKRERYRSRPQWNQVPFDGSHEEPMPLPNSMVGFSLPNDGLRSVHRNLPDQALGPPFFYYENVALAPKGVWTTISRFLYDIYPEFVYSKYFCAAARKRGYIHNLPIKNRNYTRGVSRTARYRALGNSFQVDTVAYHLSVLRDIFPNGMNVLSLFSGIGGAEVALHRLGICMKTVVLVEISEVNMTLLRSWWDQTQTGTLIEIADVQNLTAERIELFIRRFGGFDLVIGGSPCNNLAGSNRYHRDGLEGKHSALFYHYYRILDSVKTIMASIFGAKGKLFRHVRKALLLKQSSSLTLKTEQDPSNNSDKDSMDK

SEQ ID NO: 924 - protein, 700 aa, Oryza sativa
MDLYMDDYIDPYEEAEAEAAAEAAGLTSAAAAEDSSDEGDSEDDSEAESDYEERSYGLLRSGNHRVRNPDGTFRCPFCPGKKKQDYKLKDLLQHADGIGASSKRRRHGRERAFHRAFARFVRTDPSFAQDLAAINGIATTADAISNSSAAGAKEKADANGDTDGSASVAAVAAGNRREEERFAWPWSGVLAAGAGFNAEDFADRVAMFGLDDVVPLVVDDAEGADSFAIVRFANGWGGFGDALTLENHFNKNKLGKNEWDARGSAGDAVKGDDGDTDVKVYGWVAREGDYNAGNVVGRYLRKHTNLTTIDEVSKSESEKSGKMVAILATQIEAKNRFLQDLETKKNATELSIARLEEDNRKLHDAYNEEMRNLHRRARDYALRVFQDNENLKLELDSRRRELNSRAKQLEKITAENASDRKKLDDQKQKAKDDNSELELASIEQQRADEDVMKLVEDQKREKEDVLARMLQLEKELHEKQQLELEVTRLNGTLQVMKHLEGDDDGDIHDKMEKLSERLEHEKKRLEELSGELVKKERESNDELQEARKELIMGLEDMLTGRTAIGIKRMGELDEKPFQNACKRKYGNDDYETKAAELVSSWQEEIKKPSWHPYKIITVDGEDKEVVDDDDTKLRHLWIEYGDDVCNAVKTALSEVNEYNASGRYVVPELWNFRKGRKATMKEVLKYIFGQIETTSKRRRP

SEQ ID NO: 925 - protein, 376 aa, Oryza sativa
MDKCGDSDDCISTSEAAERAAKLSEDKIKNLPVPGEVEFINGGPPCQGFSGMNRFNQSPWSKVQCEMILAFLSFAEYFRPRFFLLENVRNFVSFNKGQTFRLTLASLLEMGYQVRFGILEAGAYGVAQSRKRAFIWAAAPGETLPEWPEPMHVFASPELKITLPDGKFYAAVKSTAAGAPFRSITVRDTIGDLPAVENGAGKPTIQYGSGPVSWFQKKIRSDMASLNDHISKEMNELNLIRCKHIPKRPGCDWHDLPDEKVKLSTGQMVDLIPWCLPNTAKRHNQWKGLYGRLDWEGNFPTSVTDPQPMGKVGMCFHPEQDRIITVRECARSQGFPDSYRFAGNIQNKHRQIGNAVPPPLAYALGRKLKQAIDAKR

SEQ ID NO: 926 - protein, 353 aa, Oryza sativa
MESQRSDGVEESENGPTDEDNGVSDGENEDDLGADAEKWKRQEIDEMEYDDDAEKEEGFDMDSESEEDTKSKPESEDHQAKLDEELEESEEGHVLDSSNKGENLKAKQATARLEDEMNEAEDEKAQVTIKFKKNIKWTIHYESTGLNFEVHYALQEQPHILLAQIAQRTARSVFVKACKNIDRCEVNKPKKIDNNTINTPITLQTAGVNFEVFHKLVDYLDINEVRSNDIHAMLNTYGVEAARATIIGEVKGVFGAYGIHVDMRHLNLIADFMTFDGGYRPMSRLGMGQFSTSPFGKMTFETATKFIVEAASHGESDTLDGPSASVCLGKPVKVGTGSFGLLQNFSLEQPVAM

SEQ ID NO: 927 - protein, 577 aa, Oryza sativa
MYSDHDLEGEPGAPVGSWAACSISEAAYGALDHPVNSLEDSPLMNLQEVLKCHKGTNSLDHTGLLFLSKHLRKYRYGFEYASLEVKDHLERVDFSDMVDTVIILYGGSDMQKTKGNPWITHFHLNQETMKIKRLGLEFIVREIIDQYNTLRKQLNNAIPSVSISNSKCSVGNECVKNQTCCVTMVVQVEINSMSQLDVIKERVIPSILATLLKGFLEFKNVKVQCQEDNELVLKVGMSEHCKSGKFWATLQNACIPIMELIDWERSRPERVYDNFCSYGIDSAWKFFVESLRSTTDAIGRNIHRQHLLVVADCLSVSGQFHGLSSQGLKQQRTWLSISSPFSEACFSRPAHSFINAAKRDSVDNLSGTLDAIAWGKEPCAGSSGPFKILYSGKSHETKQNEHIYDFLHNPEVQALEKNVMDTYRKRTEKTSKRRSALNSEGNATINGGAISFNQKFLNAKVGIWENIIDMRTSLQNMLREYTLNEVVTEQDKSCLMEALKFHPRGYDKIGVGIREIKIGVNPGHPSSRCFIVLRNDDTTADFSYNKCVLGAANSISPELGSYIENRRSNRAVRPHQL

SEQ ID NO: 928 - protein, 1383 aa, Oryza sativa
MARPEEKLRCTKEPFIEDVGTRRIKSIRFSMFSGNEVRQSAEVQVWNSRIYNHEMKPVPNGLLDTRMGAANKLGECSTCHGSFAECPGHFGYLKLALPVFNVGFFNCILDVLKCICKSCSRVLLMEKDRLEFLKKMRNPKADPLQKSAIMKKVRDKCKLSRCPWCGFINGVAKKGRAGLIILHDCSKTLDGSTEELRDALSHKKEKLSISAVRMLDPAIVLSLFKRMTDEDCELLNLGDRPEKLIVTEIAVPPVPIRPSVFVAGGRMSNEDSITVILKSIANTNSILKENLQTGGQFMKCFDCWQHLQLQVVEYINSDAPSLPESQHRGLVQRLKGKTGRFRGNLSGKRTEYTGRTVISPDPNLRITEVAIPILMARVLTYPERVSYYNIEKLRQCIRNGPHKHPGANFIIQPDGTKLHLKYCDRRIAARDLKYGCVVERHLEDGDIVLFNRQPSLHRMSIMSHRARIMPWRTLRFNESVCNPYNADFDGDEMNLHVPQTEEARTEALMLMGVQNNLCTPKNGEILVASTQDFLTSSFLVTRKDNFYDRSSFSLLCSYLGDAMENIDLPTPALIKPIELWTGKQLFSVLVRPNACTKVFLNLTVKEKIYKTPKGSTLEPEAMCPNDGFVYFRNSELLSGQVGKATLGNGNKDGMFSTLVRDYNSHAAASCMNRLAKFSARFIGNHGFSIGVDDVQPGEHLNQEKKMKIDGGYKDCHDLIASYSKGALRLQPGCNAAQTLEQSITRVLNEIREEAGKVCMNTLHWRNSPLIMSQCGSKGSPINISQMVACVGQQSVGGRRAPNGFIDRTLPHFPINSKTPAAKGFVANSFYTGLTATEFFFHTMGGREGLVDTAVKTAETGYMSRRLMKGLEDLSVFYDQTVRNASGGIVQFLYGDDGMDPAKMEGKDGKPLNLDQLFMKVMATCPQRGQNTLSPGEILQILNDKLSEHDASSDDGCSEKFKQLLTYFLEDRIKLLKSTRRALLLDEDHVGERHSSFEESIAANISGISVKQLQVFLDTCLSRYHLKKIEAGASIGAIGAQSIGEPGTQMTLKTFHFAGVASMNVTLGVPRIKEIINAAKKISTPIITAELLSEKDVLSARIVKGSMEKAVLGEVAEAIKIVLKSSQPNLVVKLDMQRIEALHMGISADSVQLSILNHPKIKLKSEHVRVIDKSKLRIYPAGIDKSKLLYELHHLKSMLPKVIVKGIPTVERAVISETGEENDKRYKLLVEGTNLLAVMGTPGVDAMKTKSNHIMEVNRTLGIEAARRSIIDEIQYTMKSHGMNIDSRHMMLLADLMTYKGEILGITRYGIAKMKSSVLMLASFEKTAEHLFNASYSGREDQIEGVSECIIMGIPMQLGTGILKVRQRLDHLPEFKYQPDPILA

SEQ ID NO: 929 - protein, 1570 aa, Oryza sativa
MEGHPDPTSAATAMIPEASIRRINLSITSNEEILKAQPVNELEKPIPITHQSQLLNNPYLGLPLQVGSCQSCGSNAIEECEGHFRFIELPMPIFHPSHVTELSQILNLICLRCLKIKNRKKSTLKGSKFTSCSHCQELPPLCVAEVKKSNGARGLELRAPIKKELEEGFWSFLDQFGSCTRGTSHCRPLLPEEVQNIIKKIPEETRRWLSVRGYIPQDGFILSYLCVPPNCLRVSNVLDGNTFSCSGTSTNLLRKALRKIQQIRGSRIGSSNIQVDQVADDLQVDVANYINLGGTTKGHGDDTFTSQPTAMQWKQKMKTLFISKSSSFSSRGVITGDPYIGLNVVGVPEEVAKRMSVEEKVTDHNIAQLQDMMNKGLCLTYTDANSITYSLDAGKDNPNKKHTILKVGEIVNRRVFDGDIVFLNRPPSTDKHSVEAFYVQVHNDHTIKINPLICDPLGADFDGDCVQIFYPRSLSARAEAKELYTVDKQLVSSHNGKLNFQFKNDFSLALKIMCGREYSEREANQITNAMFSSGMYPQKPLIGGPYWTFPQILETTKSNAITLADHLDRESVGALATGTTISSILSTKGPREATEFLNLLQPLLMESLLIDCFSINLGDFTVPSPILEAIQNNPLELNKYREPIMDFITHSSAIGLLVDPKSDSNMNKVVEQLGFLGPQLQHNGRLYSSRLVEDCLSKSLHRCCGSTNCCNPLEEYGTVRSSIYHGLNPYEALLHSICEREKIMRASKGLVEPGSLFKNMMSRLRDVTACYDGSIRTSSGNLVLQFGSRDASNCVTPGDPVGILAATAVANAAYKAVLAPNQNNIISWDSMKEVLLTRASTKADANHRKVILYLNQCSCENECMERALTIRACLRRIKLEDCTTEISIKYQQQATQAAHHLVGHIHLDKKQLNQIETIMDSVLHKCQETFRNNIKKKGSMREILKTVTFISSTSLCDQHTDDDKKFQVSCLQFFLPGSITKNISESTERVIDFMTNAIFPIILDTVIKGDPRVEEANLVRIEPESTFWVQSSGAEQKGEAALEITVEEAAAAESGNAWGVAMNACIPVMDLIDTTRSMPYDIQQVRQVFGISSAFEKVTQVQLFPFLLLAEIQYLSKSVGMITKSVLQEHLTTVASSMTCTGDLHGFNNSGYKATCQSLKVQAPFMEATLSRSIQCFEKAAAKAYSDQLGNVVSACSWGNNAEIGTGSAFEILWNDENMSSSKSILGGYGLYDFLEAVETTGATKDKAIVPHNYCLYDVDCIPEDKVCLEENNQITWTDKPKAEFLMESEGRRAGMHSTGQKHPRKPNWHEGNTKSSPNSTAVEFTGQVFQRRQLKTKSNWNSDATQQDDKPSWYSSNSAGTQNFTIAGSSRPGEWNRKNNNRGQGGGREVWKSEGPHRGGSSSNRNQGGGRAVWKSEASHRGSGNNRNRGGGRAVWKSEASRRGGSMRQVASCAFTPVEQQIFEQIEPITKNVKRIIRESRDGIKLPPDDEKFIVTNVLMYHPERKKKIAGNGNYITVDRHQVFHGSRCLYVMSSDGSRKDFSYKKCLENYIRAQYPDAADSFCRKYFK

SEQ ID NO: 930 - protein, 2017 aa, Oryza sativa
MEEDQSAIPVAEGAIKSIKLSLSTEDEIRTYSINDCPVTHPSQLGNPFLGLPLETGKCESCGASENGKCEGHFGYIELPVPIYHPCHVTELRQILNVVCLKCLRVKKGKVKQTEGKDNTSALSCYYCRDLPALSLKEIKTADGAFRLELKMPPRKFMTEGSWNFLDKYGFHHGGTSHCRTLLPEEALNILKKIPEETKRKLAARGYIAQSGYVMKYLPVPPNCLYIPEFTDGQSIMSYDISISLLKKVLQKIEQIKKSRAGSPNFESHEVESCDLQLSIAQYIHLRGTTRGPQDNTKRFAISTDPSALSTKQWLEKMRTLFISKGSGFSSRSVLTGDPYIGVDVIGLPSEVAKRITFEEQVTDINLNRLQEIVDKGLCLTYRDGQATYAITVGSKGHTTLKVGQTISRRIVDGDVVFLNRPPSTHKHSLQAFRVYVHEDHTVKINPLICAPFAADFDGDCVHIYYPQSLAAKAEALELFSVEKQLTSSHSGKVNLQLVSDSLLALKHMSSRTMLSKEAANQLAMLVTCSLPDPAVIKSKPYWTISQIVQGALPKALTSQGDKHVVRDSTIIKLDLDKESVQTSFSDLVYSTLSVKGPGEALQFLNVLQPLLMELILLDGFSVSLQDFNVPKVLLEEAQKNIEKQSLILEQSRFAENQVVEMRVDNNLKDIKQQISDFVVKRSHLGLLIDPKSDSSVSKVVQQLGFVGLQLYREGKFYSRRLVEDCYYTFVNKHPAVREEHSPEAYGLVRSSYFHGLNPYEELVHAISTREAIVRSSRGLTEPGTLFKNLMALLRDVVICYDGTVRNVCSKSIIQLNYTEDDALDFPSAIGPGEPVGVLAATAISNPAYKAVLDASQSNNTSWERMKEILQTTSRYKNDMKDRKVILFLNDCSCAKKFCKEKAAIAVQGCLRRITLEDCATDICIEDGNWAAPAGFQHPVPPPQCKILPVPIPIPAHGSVKFPPVPIPAPEHLKYNIHVVRYQKQIGLDGTSEAAPALVGHIHLDRAHLERINISTEDILQKCQEVSGKYGKKKGHLSNLFKNITFSTCDCLFTQKLVDGKLPKLPCLQFFVSDNMIVSESVERAVSVLADSLCGVLLNTIIKGDPRIQEAKIVWVGSDATSWVKNTQKASKGEPAVEIIVEEEEALHIGDAWRTTMDACIPVLNLIDIRRSIPYGIQQVRELLGISCAFDQVVQRLSTTVRMVAKDVLKDHLVLVANSMTFTGNLNGFNNAGYKATFRSLKVQVPFTESTLITPMKCFEKAAEKCHSDSLGCVVSSCSWGKHAASGTGSSFQILWNESQLKSNKEYGDGLYDYLALVRTDEEKARYTFFDDVDYLAEENEADVCLSPELDGTIGQPIFDDNLEEQDVQNNSSWDNGTTTNASWEQNGSAGNDSDKWGGWNDAAAGADTGVTKPANQGNSCWDVPATVEKSSSDWGGWGTEKAKEKEKISEEPAQHDAWSVQGPKRATDGGASWKKQSSTQNDGNSWKENKGRGSNGGSWEKDNAQKGSWGRGNDEAENNNDVQNKSWETVAADAHASTEKSWGNVTASPSDNAWSAAPVSQGNGSSDTKQSDSWDGWKSAGVDKAINKDKESLGNVPASPSFSAWNASPVSQGNERSDAKQSDSWDGWKSAGVDKAINKDKESLGNVPASPSFSAWNAAPVSQGNERLDAKQSDSWDGWKSAGVDDSVKDKESWGNVPASPSDSAWNAAPVSQGNESSDAKQSDSWDGWKSAGVDASTNKDKESWGNVPASPSDSAWNAAPVSQGDDVWNSAEANESRNKDWKSDGWGARGGNWRGQRNNPGRPPRKPDGRGLPRRPDERGPPRRHFDLTAEEEKILGEIEPTVLSIRKIFRESIDSIKLSPEDEKFIKENVLEHHPEKQSKVSGEIDHIMVDKHQVFQDSRCLFVVSSDGTRSDFSYLKCMENFVRKTYPEHGDSFCKKYFKRRRDQPPAADGGTAPGTPAGATQSTAVDTQEGTSQQTQPDIATAPAATQQETLQDTPAPPADDGLLGKGPSPSD

SEQ ID NO: 931 - protein, 1257 aa, Oryza sativa
MWDEKERPRVFCLAPQDGEAVWWLAMEDPEITGQQSPNATSIVTDLMDLDDIIVEGNEVQFAMDVDLRAIPSLKDGGHTDPLVQIPGDMSHMDVDLRVIPSLKDGGHADPPVQVPVDKRIASLEKLCKEASRSFFRETRLVSHQINSYNDFVSHGLQKMFDSLDEVTVEPDYDPSKKVGPWRHATIKFGRVELEEPVFWVDNCDLDVETLKLKPKHARLQKMTYSSKMKVEMTVQVYSLHKSDKAKTGEDPYIQRKDIMKETKWVTIGKLPVMESECEYDFGGYFLIKGMEKVFVAEEQRCLSRIWINDSPTWEACYQRSQIRREKISIKPVQSNDGFRKVINLYFLGATIPIWIMFFALGVSSDKEAFDIIDIQECDASMANIISATITESHEQCEGFQREGRASEYIDKLIRNTKFPPKGSFDEYIGRHMFPDVSGNRSKALFLGYMVRCLLLASSGNRKSDNRDDFRNKRLDLACELLQRELWVHIMHAQKRMVKVMQRHLSGDGDLQPLECYVHASIVTNGLNRAFSTGSWCHPFNKRERCSGIVATLRRTNPLQMMSDMRKTRQWVAYAGKAGDARYPNPSYWGKLCFLSTPDGEKCGFVKNLAITAIVSCLAREPSVDALVSCGMKKLDELLLQEISGKDRIFLNGNLVGVCADSVEFVLHLRSMRRRKQIDAQVEIKRDKQNKEVRIFSDPGRILRPLLIVENLRNIMNRKNGSYSFQELMDQNIIELIGVEEEEDIRCAYGIRHLFAGDEEKNFSFYTHCELDPSFLLGLSCSIIPFANHDTAKRILMQAEKISQQAIGYSTTNPLFRVDTHSHQLYYPQRPLFKTVAADCLGKRDYTSGSKHDFARPEYFNGQNAIVSISVHQGFNQEDSLVLNRASLERGMFRTQHFKSYKALIENKEITKRLKHKENINFGKTPSKKGLVDSLDIDGLPYIGASLQSNDIIIGKVSDSGEDHSIKLLHTEKGIVEKVVLSATDDGTNSAFVTLRQTRSPRIGDKFASMHGQKGVIGFLDSQENFPFTHQGIVPDIVINPHGFPTRQTPGQLLEAALGKGIALGGATRYATPFTSPSVEVITEQLHKAGFSRWGGESVINGRTGERAASPVFTGPTFYQRLHHMAEDKVKFRNTGPVHPLTRQPVEDRRRYGGVKFGEMERDCLLAHGAAANLHERLFLLSDVSRLHVCRRCQRAAVVVSPAVAADGGGGRKVRGPYCRFCRSAEEVVRVSVPYGAKILYQELFSMGICLKFDTELI

SEQ ID NO: 932 - protein, 1252 aa, Oryza sativa
MEEPSKDNGQSSCVVDPELEPMMLDDAREGVSHTLDDANGHSSMDVDRGCHSMDTTRSSLGDDGKGKRDSYAQIPVDMSIPSLEKFCKEASRSFFDEIGLISHQINSYNEFVSHGLQELFDSLGEVTVEPSYDPSNRGPGGWRHAIIKFGRVQLEEPVFWSHGCDIDEQSLKLKPRHARLQNMTYSSKMKVEVHFQVYSMEKSDKAKTGNDKFGYKRNIINETYYINIGRLPVMVMSNLCWLHKLKESDCQFDSGGYFLIKGMEKVFIAQEQKCLTRIWVEDRPCWMVSFLSPIRRRRIYIKLIDSANNEDASGGKIISISFLYANMPIWLMFFALGISSDKDIFDVINMEDCDACVINTITATIKESDELCEGFRKSDKARQYVDELIKNSKFPPAEPFDDYIAKYLFPSISGNRNKALFLGYMVKCLLMAFTGKRKCDNKDDFRNKRLDLAGELLGRELRAHIRHAERLMVKALQRDLNSERELQEFDHYLDASIITNGLNRAFSTGSWCHPYKRNERCAGIVATLRRTNPLQMISDLRKTRQRVAYAGKAGDARYPNPSYWGKLCFMSTPDGENCGLVKNLAVTATVSSRVAPPLIDRFISCGMNKLHEIPTEEVPRMDKIFLNGDWVGSCSDPASFVLRLRCMRRSGLIDPQVEIKRDKHQREVRVFSDAGRILRPLLVVENLNKIRRPKGSSYSFQWLMQQEIIEFIGVEEEEDIRSAWGIRNLFESEEEAPMVKMNKAEDVFNVKRKIGGEVSGYTHCELDLSFLLGLSCGIIPFANHNFARRVLYQSEKHSQQAIGYSTTNPHIRVDTLSHQLYYPQRPLFKTVIADCIGRSEYTFGRKDDFARPEYFNGQNAIVAVNVHQGFNQEDSLVMNRASLERGMFRTEHFRNYKAEVENKGGPGGNKRLKMKDKIDFGKMQSKRGRVDNLDDDGLPYVGASLQSGDIVIGKVSESGEDHSIKLKHTEKGMVQRVLLSANDEGKNFAVVTLRQVRSPCLGDKFSSMHGQKGVVGFLESQENFPFTYQGIVPDIVINPHAFPTRQTPGQLLEAALGKGIALGGTMRYATPFTTASFDVITDQLHKAGFSRWGAESVLNGRTGERMHSLIFMGPTFYQRLIHMAEDKVKFRNTGPVHPLTRQPVADRKRFGGVKFGEMERDCLLAHGAAANLHERLFMLSDFSQMHVCQTCERVANVIMRPVPGGKKIRGPYCGFCRSSENIVRINVPYGAKLLYQELFSMGICLRFETEVC

SEQ ID NO: 933 - protein, 1136 aa, Oryza sativa
MPTAAAAATASLRVSNIPPSAVAAELLAFFDSAVAVAGGAFACEIAAAHRGWLSRGHGTVQFGSAAAAAAAAGLASSGRLPRFLGALLSVSPSPVDLLPRASDLSLRAAGAGLVVGDRVAERVFEAADAWDGVRAEVIPGKRRVDLYLEHDSQRYKLEVLFEDMKDCLGCTLDGMGAILLQLNYAPRIHTAISGPAVNSRFMDDRFHACKEDAKFSWVRALDFTPNYSFGRCSTLVLKLGKSALVSDILKSLPFSGNLGELTMNSMDGVGASSNVVPLVHCPRDYSVPYEVLFRLNSLMHMGKIVAKHVNADLFKALQELPVDVSRRIFEKMHKLESTCYGPLQFIQQEAYSMKRSHNVLLSNEGEGEGERKLMKCYRVNITPSKIFCFGPEEEVTNYVVKHHSAYASDFVRVTFVDEDWSKLSSNAISARIEQGFFSKPFKTGLYYRILSILKKGFSIGPKNFEFLAFSASQLRGNSVWMFASNASLNAGGIRRWMGHFENIRSVSKCAARMGQLFSSSRQTFEVLRWDVEVIPDIEITTDGSKYIFSDGIGKISLRFAKRVAHHVGLDPTNLPSAFQIRYGGYKGVIAIDPMSSIDLSLRPSMKKFESESRMLNITSWSKSQPCYVNREIISLLSTLGIRDEIFVAMQQDEMRETEEMLTNKEVALSVLGKLGGSETKTAVKMLLQGYEPSSEPYLSMILKAHQENRLTDIRTRCKIHVPKGRVLIGCLDETGVLEYGQVYIRITKNSKEQKDSNQSYFYNDDGKTATVVGKVAITKNPCLHPGDIRVLEAIYDPDLVGMVDCLVFPQRGERPHPNECSGGDLDGDLYFITWDDKLIPEKVDTPMDYTATRPRIMDHVVTLEEIQKHFVDYMINDSLGAISTAHLIHADRSPLKARSPECLQLATLHSMAVDFAKTGAPAEMPRTLRPREYPDFMERWEKPMYISNGVLGKLYRSAMGHMEKSGDSGALSSSSAQPSPTYDPDLEVPGSDEFLQAAEEYYELYEEKLTTLMNYYRAELEDEILTGNIRNKMLYLKRDNKRYFEMKDRIVAAVDALHREARGWLLSSRKEEDASRMASAWYRVTYHPDRRRGKRFWSFPWIACDNLLAIKASSQLRRRRQKDDDSTAVVQMDCSA

SEQ ID NO: 934 - protein, 1218 aa, Oryza sativa
MRSPRGGAAAQPSGRRGDTTAAAAGDLVTTQVSLGGFDAGVAAGDLADFLEHEVGLVWRCRVKTSWTPPDSYPDFALPTAPASASAAAAPPRYDRVPPHAFVHFARPEGARRAADLAGETRLILRGKPLRVASAPDSSLRVSRRSSIAPFRFPDVRLEVGALPSPGAFLAAWRGPDAGLDLSVDPFDGCCRLVFTRDTAFTFPGFREVAAIRCDVKLEFPVRDVLEVRLYRLDCSLLLRLAAAPLVHYRTADDDFHEPVPFDLLDDDDPWIRTTDITPSGAIGRCGVYRISFSARFWPKMDRALDYMRERRVAIVDCGGGWGPRRGLTVRDELEFGEPMQDVFFCLQHAEGLKFPLLFMVNALVHKGIINQHQLTPEFFSLLGRSEENVNVAALRDFWGDKFPVFDACGRLKKALNRVARNPKLLCSKVGDDHAEVRRLVITPTRAYCLPPEVERSNRVLRHYHEVADRFLRVTFMDEGMQVLNNNVLNSFTAPIVKDLMSNFFQQKTTVYKRVRMLLTEGFHMCGRKYSFLAFSSNQLRDKSAWFFAEDRKTTVEAIRKWMGRFTSKNVAKHAARMGQCFSSTYATVTMRPDEVDESFDDVVHNEYIFSDGIGKITPDLALEVAERLQLTDNPPSAYQIRFAGFKGVIAVWQGHGDGTRLFLRPSMRKFESNHLVLEVVSWTKFQPGFLNRQIIILLSSLNVPDSIFWQMQETMLSNLNNILSDRDVAFEVLTTSCADDGNTAALMLSAGFEPRTEPHLKAMLLAIRSAQLQDLLEKARIFVPKGRWLMGCLDELGVLEQGQCFIRATVPSLNSYFVKHGSRFSSTDKNTEVILGTVVIAKNPCLHPGDVRILEAVDVPELHHLVDCLVFPQKGERPHANEASGSDLDGDLYFVTWDEKLIPPGKKSWNPMDYSPPEAKQLPRQVSQHDIIDFFLKNMISENLGRICNAHVVHADLSEYGAMDEKCIHLAELAATAVDFPKTGKLAIMPPHLKPKVYPDFMGKEDGQSYKSEKILGRLYRSIQEASNGDVVSQEVCTPNDLPYDIDLEVPGASDFLASAWQCKCSYDAQLSALLSQYRVRTEAELVTGHITFLVKNSSKKQGDIKDRLKTAYSALRKEFKSTFESIASDQCEIGDDEKNLLYEMKASAWYQVTYHPKWVEKSRGILGPDGEEIPASLSFAWIPVDYLARIKLRCHGKVRVEGQKPVERLAAYISERI

SEQ ID NO: 935 - protein, 609 aa, Oryza sativa
MASAGDRRGGGGPPGSGDDSGGGWETVEKRVKKPAQQVGKGQWGQWNSPNAAPAPTAPRSGSGAFHHSGNTLVRHSDRRPARGTPRPPPQNRSIEAELQAPHGVVTAPLANGWQWGARSCPPGTESKEGGLPLSGCDPETDNAEGYDTSDDDNDDDMSDDLSDDYDSDASEKSFETRKNHKLFKGFFEVLEALSVEQLNEPTRQWHCPACKNGPGAIDWYKGLQPLMTHAKTKGSIKVKRHRELASLLEEELSRRGTSVVPSGEQFRKWKGLRESTDREIVWPPMVVVMNTVLEQDEDDKWKGMGNQELIDYFSEYAASKARHAYGPNGHRGMSVLIFDSSAVGYMEAERLHDHFVRQRTDRNTWNSAHKVTFLPGGKRQLYGFLATKDDMETFNRHCHGKSRLKYEMRSYNEMVVTQMKQMSEDNQQLNYLKNKMVKKEQHSKLVEDTLSVVTQKLRETMEENTIVRNKAKEKHLEYEKEMKYQEEFFHDQIEKIHKATEEKEIKFEKLLQEERAKARQSDVDSGSTEDRRQRKEKIQNFIDCQVKDVEEFEAERDKLIKLHEEKKVKLKKEYLAKEFELEKELDTALTSLMDKHKPDIFKSSTSPST

SEQ ID NO: 936 - protein, 682 aa, Oryza sativa
MPGGRRGGGGRPGSGSSSNGGGSGYSWVEKKSKKSEKSVGKGQCAPCTSSNAAPKPAMAWQARSGNGSLHPPGNGRVQHSDHRPAARGSPRSLPQNKHTETKLQAPCPVVTAPLANGLQWVPKSRSSGSESNMDDAPTSGSDPEMDNGATHPVVTATLANGLQWVPRSRSSDSQSNKDDAPTASSDPETDNVAPHPVVSAPVANGLQWVPRSHSSGSEMDNGEDYDSYDDDSDDDMVDDTSGDFDSKASEKNFETRKRHKLLKSIFELLEKLSVEQINEKTRQWHCPACKNVRGGVTWYKGLQPLMNHARTKGSKRVKLHRELAALLEEELYRTGISMASSGEFFGIWKGLRENTDRPIVWPPVVIIMNTRLEQDKDGKWKGMGNKELLSYFSKYHVKEACHAYGPDGHSGMSALIFEGSAVAYKEAERLHNHFVDQRTDKYAWLNHRIVIPGGKRQLYGFLAEKEDLEAFNRHHGKDYLKYEMKSYNEMVVTQLKQMSEDNQQLNYVKNEMVKTERHSKEVEEALGVETQKLQGAIEDNIILKRKTKEMLSECVEQMEFNAKFYHEQIERLRKDTEEKENEFERLLQEELARAIECDVDSETTENCKLREEQIQRIIDCQVKDAEEFDAEQDELIKTHEEKKANVKMEYMAKDVELEEELYAALTSLMEKHKPDIFQPSSP

SEQ ID NO: 937 - protein, 684 aa, Oryza sativa
MEMDTSPSSSAPSSPAASSDSIDLNFLPFLKREPKSEPASPERGPLPLPAAAPPPPPPPPPPPPPPQVQAATVATPVPATPDLSAAAVMTPLQSLPPNPEEETLLAEYYRLATLYLSSAGAAGVIVPAAAPEASAGAVAQPGSGSGAKKRRPRSSELVRVSSLSVQDQIYFRDLVRRARITFESLRGILLRDDERAEVLGLTGVPGFGAVDRRRVRADLRAAALMGDRDLWLNRDRRIVGPIPGISVGDAFFFRMELCVLGLHGQVQAGIDFVTAGQSSSGEPIATSIIVSGGYEDDDDRGDVLVYTGHGGRDPNLHKHCVDQKLEGGNLALERSMAYGIEIRVIRAVKSKRSPVGKVYFYDGLYKVVDYWLDRGKSGFGVYKYKMLRIEGQESMGSVNFRLAEQLKVNALTFRPTGYLGFDISMGREIMPVALYNDVDDDRDPLLFEYLARPIFPSSAVQGKFAEGGGGCECTENCSIGCYCAQRNGGEFAYDKLGALLRGKPLVYECGPYCRCPPSCPNRVSQKGLRNRLEVFRSRETGWGVRSLDLIKAGTFICEFSGIVLTHQQSEIMAANGDCLVRPSRFPPRWLDWGDVSDVYPEYVAPNNPAVPDLKFSIDVSRARNVACYFSHSCSPNVFVQFVLFDHYNAAYPHLMIFAMENIPPLRELSIDYGMIDEWVGKLTM

SEQ ID NO: 938 - protein, 740 aa, Oryza sativa
MMDWFMSTVYFYGPEINVSNRVVRNFSSDIENFLRISFVDEDCEKLRATDLSPRSASGHDANRTALYKRVLSVLSDGITIGGKNFEFLAFSSSQLRDNSAWMFASRQGLAASDIRTWMGDFRNIRNVAKYAARLGQSFSSSTETLKVQKYEVEEISDIKNGTQHVFSDGIGKISSAFANEVAMKCNLKRFAPSAFQIRYGGYKGVVAVDPTSRWKLSLRKSMLKFQSDNITVDVLAYSKYQPGFLNRQLITLLSTLGVRDSVFEQKQEEAVNQLNKMVTDPQAAIEAIELMPMGEITNAVKELLLCGYQPDDEPYLSMLLQTFRASKLLELKTKSRILIPKGRAMMGCLDETRTLKYGQVFIRATSGVNDNDRFTVTGKVVIAKNPCLHPGDIRILHAVDVPVLHHMFNCVVFPQQGPRPHPNECSGSDLDGDIYFVSWDPSLIPPRMVTPMDYTPAPTETLDHDVTIEEVEEYFTNYIVNESLGMIANAHVVFADKEDLKAESSPCIELAKLFSIAVDFPKTGVPALIPPELHVKEYPDFMEKLDKVTYESKGVIGKLYREIKKHTPHIKHFTREVARRSYDTDMIVDGYEDYITEAMALKDEYDFKLGNLMDHYGIKSEAEIISGCILKMAKNFTKKSDADAIRLAVRSLRKEARSRFSEMSLDDNGHGHDASEAKASAWYHVTYHPEFWGCYNEGYERPHFISFPWCIYEKLLRIKQRRKFVRKMQPELFSLHNLRI

SEQ ID NO: 939 - protein, 1052 aa, Oryza sativa
MASRGGDGLVGGGRGPLGGRDGRGRGPAGGRGGGRGGGHPQQQQQQQPGYGRGDGGGRGPAPAAGGVVGRGTGGGGGGGRGDGGRGRGRGGGGGDGVRPAMAAAPAASTPGPVAVAARSTPPPTPAVQIPAVASSSSAQPAAAAQPPPAAAAVSALARDVGRQLAVVAGGGRPAPPAAPPAPIPVSSKGVAPPSRPGFGTVGERIVVRANHFLVRVSDNDMIYLYDVSLSPPPKTRRINRVVMSELARLHRESHLGGISFAYDGSKALYTAGKLPFDSMDFKIKLGKELREIEYKVTIRRAGQADLHHLHEFIAGRQRDSQQQTIQALDVVLRESPSLNYVIVSRSFYSTMFGRQDIGDGLECWKGYYQSLRPTQMGLSLNIDISSTPFFKPISVVEYVKNCLGTPTNANGPDPRRPLSDIDRLKVKKALRGVRVETTHQGKSSKYKITTITSEPLSQLNFSMDGTTQTVIQYFSQRYKYRLQYTSWPCLQSGNPSNPIYLPMEVCTIVEGQRYSKKLNDKQVTGLLRATCQPPQKREQKIIEMVQHNNYPADKVVSDFRINISNQMATMPARVLPAPTLRYHDSGKEKTCNPRVGQWNMINKKMVGGAVVQKWTCVNFSRMHIDAVHRLCGELVYTCNAIGMVFNEMPEIEVGSAAPNNIEAALSNIHTRAPQLQLLIVILPDVNGYYGRIKRVCETELGIVSQCLKPGRKLLSLDRQFLENVSLKINVKAGGRNSVLQRPLVPGGLENTTIIFGADVTHPASGEDSSASIAAVVASMDWPEITKYKALVSAQPPRQEIIQDLFTMTEVAQNADAPAQKAEGSKKNFICGGMFRELLMSFYSKNAKRKPQRIIFYRDGVSDGQFLHVLLYEMDAIKKAIASLDPAYRPLVTFVVVQKRHHTRLFPEVHGRQDLTDRSGNVRPGTVVDTNICHPSEFDFYLCSHAGIQGTSRPTHYHVLHDENRFSADQLQMLTYNLCYTYARCTRSVSVVPPAYYAHLAAFRARYYDEPPAMDGASSVGSGGNQAAAGGQPPAVRRLPQIKENVKDVMFYC

SEQ ID NO: 940 - protein, 1058 aa, Oryza sativa
MAYRGGGRGGRGGEQRPPYSGRGDVPGRGGGGGGGGAPPYRPASGFVWPPPGMTPRPGPPQPQYPRPGPPAVVYGAPMPAAHHQGAYQPGGVYRAPSPGVPVIGGYARSTPVTIRAPPPSHSSAPAPYQPAAAAPAPSSSSTAPSATALAKEFEQKLFVSETALAPPAAVASAAAAPAGEASVESDKDLAPVSKKGLAHPARPGFGAAGKKVMIRANHFLVNVADNNLFHYDVSINPESKSRATNREVLNELIKLHGKTSLGGKLPAYDGRKSLYTAGSLPFESEEFVVKLIDPEKKDKERAEREYKITIRIAGRTDLYHLQQFLLGRQRDMPQETIQVLDVVLRESPSWNYVTVSRSFFSTQFGHRGDIGEGLECWRGYYQSLRPTQMGLSLNIDISATSFFKPVTVIQFVEEFLNIRDTSRPLSDRDRVKIKKALRGVRIETNHQEDQIRRYKITGITPIPMSQLIFPVDDNGTRKTVVQYFWDRYNYRLKYASWPCLQSGSDSRPVYLPMEVCKIVEGQRYSKKLNDKQVTNILRATCQRPQQREQSIHEMVLHNKYTEDRFAQEFGIKVCNDLVSVPARVLPPPMLKYHDSGREKTCAPSVGQWNMINKKMINGGTVDNWTCLSFSRMRPEEVQRFCGDLIQMCNATGMSFNPRPVVDVRSTNPNNIENALRDVHRRTSELLAREGKGGLQLLIVILPEVSGSYGKIKRVCETDLGIVSQCCLPRHASRPNKQYLENVALKINVKVGGRNTVLERAFIRNGIPFVSEVPTIIFGADVTHPPPGEDSASSIAAVVASMDWPEITKYRGLVSAQPHRQEIIEDLFSVGKDPVKVVNGGMIRELLIAFRKKTGRRPERIIFYRDGVSEGQFSHVLLHEMDAIRKACASLEEGYLPPVTFVVVQKRHHTRLFPEVHGRRDMTDKSGNILPGTVVDRQICHPTEFDFYLCSHAGIQGTSRPTHYHVLYDENHFTADALQSLTNNLCYTYARCTRAVSVVPPAYYAHLAAFRARYYVEGESSDGGSTPGSSGQAVAREGPVEVRQLPKIKENVKDVMFYC

SEQ ID NO: 941 - protein, 973 aa, Oryza sativa
MAPPRHQPAAGKAGGGRGHGHGHGHGGGGGGPAARKQPLQSSMAQPKAETAAATAAVAPPEGGKKCGGGGGRRRGGRGRGGRAGAGPGPGLAAAPAVVVAPAARAVIGPPVASKGLSFCRRPGFGTVGARCVVKANHFLAELPDKDLTQYDVKITPEVSSRSVNRAIMSELVRLYHDSDLGGRLPAYDGRKNLYTAGTLPFDAREFVVRLTDDDDGTGVPPREREYRVAIKFAARADLHHLRQFIAGRQADAPQEALQVLDIVLRELANRRYVSIGRSFYSPDIRKPQRLGDGLQSWCGFYQSIRPTQMGLSLNIDMSSTAFIEPLPVIEFVAQILGKDVISRPLSDANRIKIKKALRGVKVEVTHRGNVRRKYRISGLTTQPTHELIFPIDDQMNMKSVVEYFKEMYGFTIQHPHLPCLQVGNQKKANYLPMEACKIVEGQRYTKRLNEKQITSLLKVTCRRPREQEMDILQTVQQNGYEQDPYAKEFGINISEKLTSVEARVLPAPWLKYHDTGKEKECLPQVGQWNMVNKKVINGCKVNHWACINFSRSVQETTARGFCQELAQMCQISGMEFNSEPVIPIYSARPDQVEKALKHVYNMSLNKLKGKELELLLAILPDNNGSLYGDIKRICETDLGLISQCCLTKHVFKISKQYLANVSLKINVKMGGRNTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFANNHKDRSSTDKSGNILPGTVVDSKICHPSEFDFYLCSHAGIQGTSRPAHYHVLWDENNFTADEMQTLTNNLCYTYARCTRSVSVVPPAYYAHLAAFRARFYMEPEMSENQTTSKSSTGTNGTSVKPLPAVKEKVKRVMFYC

SEQ ID NO: 942 - DNA, 3690 bp, Triticum urartu
atggaaaaaattgttggtactggcaacgtctttgcgatcaagctcaggcctccaaagaacatctctgcaaactcaaaatcttttgccattgttcagttccagtctgaggcacatgcttcgctggtgttgaatgcggcccgacggaatgcacttaggagtggaagtaatcatctgaaggcccgatatgcagagcgtgacattgttccaagaccgagaactacgatttttaatctacaggatgcaacactgcattttggctgccttctgagggaaaaagttctatctgttctgtggagcggaacaaatgtttccgttgagtttggatttgctatgaagaggattgacttttgcctgatctacaactcgaagaaatacaaacttgaactctcctacgagagcatatgggagatccagcttcatcgtccacctgggttgcaaaaaaagttccttctgattcagttgtttctgtttattgaaagctcagagatttttgttaacctcagttggagaaatgtatccgtttctcaggttcaggctgctccgaaaatttacgaacaaaatatacgccgttctggttctatgtacgatgatcctttattcaactattctagggatgatacagatgaccagtggaccagaacaactgattttaccccatcagccagcattgggcaatcatatatcctatgtctggagctaccacatatttgttatctcccgaacatccgagagtactttgtttactatgaagtacacgatgacgtcttccatctccagcgtggacattcatattcaagcaatacttgctttgttccagttgtgaaatctcatcatttcactgatgtcccctacgagatactctttaagatcaaccacttggttcagaatgggacacttagtgggccaacacttgatgacaacttctaccgtctggtcagcccaggatatgaatgtattgaccatataaagcgtgcacttgaaaagatgtcatacctaaaaaagacttgtttgaatccaacaaagtggttatctgaacaatacaaaaaaaatcgaagatcacgctacatgttaaaatcaccaaacataaccctggatgatgatgggttggtatatgtctacagggtgcaaattacccctgcgaaagtgtacttttatggtcctgagattaatgtctcgaatcgtgttgtacggcattacgctgctgatttggataacttccttcggatttcgtttgttgatgaggactgtgagaagcttcgttcaactgatttatcacaacgctctgctccaggaaataatacaaggaggactgctctttataacagagttctttcggtcctttcaaatggcatcactatcggtgacaagcactttgactttctggctttttcttcaagccagctccgagataactctgcatggatgtttgcttctcgaacggggttatctgccagtgacatcagggagtggatgggggacttccgtaatattagaaatgtggcaaagtatgctgcaaggcttggtcagtcttttagttcctcaacagaaactttgaaagtgcataagtacgaggtgaaagaagctccagatgtaacaaacggaacaaagtatgtattctcggatggaattggaaccatttcagctgattttgcagatgaagtgtctaagaagtgcaacttgacctgctttactccctccgcttttcaaataaggtatggaggttacaaaggtgttgtcgctattgatccaacatcacgctggaaactatctttaagaaaaagtatgtcaaagtttcagtcagaaaacatcacacttgatgtccttgcatacagcaagtaccagccatgtttcctgaaccggcagttaatcactcttctttcgacactcggagtcagagatagcatatttgaactgaagcaacaagaagctgtgaagcagttgaacagaatggtagctgaaccacaagctgctattgatgcaattgagcttatgcccatgggtgaggttacaaatgttgttaaagagttgctgttatgtggctaccagccggatcttgaaccatatgtttctatgcttctacaaacctttagagcatccaagctgctagaattgaaaacgaggtcaaggatatttgtcccaaaagggcgagcaatgatgggatgcctggatgaaacccgcacactggagtatggacaggtattcattcaagtttctaatagtgcagataaccgtggaaagtccatcgtaactggaaaagttgtcgttgccaaaaacccttgcatccaccctggtgatatccgtattctccaggctgttcaaagtcctcttttgggccacatggttaactgtgttgtctttccacagctggggccaaggcaagtatttagtaatgcattcttctatgttttccagcctcatcctaatgaatgttcagggagtgatcttgatggggacatatattttgtttcatgggacccagatctcattccaactcgtatggtggcgcctatggactatactccagcaccaacagaaacattagatcatgatgttatgattgaggaagtacatgagtatttcacaaattacatagttaatgagagtctgggaatcattgccaacgcacacgtagtctttgcggatagggaaatcctgaaggctgaaagtacaccatgcattaagctggcagagctcttctccattgctgttgattacccaaagacaggagtgccggctcaaattccgcctgaactacatgtgaaggagtacccagatttcatggagaagctcgacagggctacctatgtatccaagggagtaatagggaagctctaccgggaaattaagaagcagaaccctcacattggacacttcacaaaggatgtggcaaggcggtcctatgacactgatttgatagttgatggctaccaagactacattaccgaagctgtgtggttcaaggaacagtatgacttcaagctgggtaatctgatggagcactacggaataaatagcgaggctgagataataagtggatgcattcttaagatagcaaataattttaccaagaagaacgacgccgatgctatcaggctggcggtgaaatctttgcggaaggaagcaaggtcatggttctgcgagatgggttcagatgagagcggaggtggtcacgaggcctcggacgccaaggcatccgcttggtatcatgttacctatcaccctgagtactggggttgctacaatgaaggatatgatcaccggccacacttcatcagctttccgtgcttggatgatgaagaatgggaagtgaggttccatttcctagacagagataacttggaaagaacaatctgtttatcagacataaccttctggaatctcattgccctaatagaggtagaaggctatagttcaagggattttatgtattatgttagagatccaggagctgcggtgtcaggaatggaagaattaactgatgatgacaaggtggaagaaatgttggatcacatagctagtaaaggaaagaatgttgttaacattacagttatgagaagtgatgcacctagaccagttgatttgaacattggtcatgcttatgaagagcaagttcctttgtcagaaatacgtgtaccagttgtctatgaggtagacaattcaggagttcttttccccagtccagtgaaatga

SEQ ID NO: 943 - DNA, 2238 bp, Triticum aestivum
atggaccggacatcgaatttcatgcctactcctgatcaggatgtcctggatatccagcccctgaggactttggctcccatgttccctgcgcctctgggggtcaacacgtttaacgtgcccaacaccaccccaccattgatatttgtcacttcagctgggcagtttccagggggggttggtgctccgggccatcctgctttcaggtcattcgccgccgctttcggtgctcaagatgcttatggagggcagcctgcctcttctggtggccagcatgacggtggagggcatcctgcctcttctcgtcgccaggatggtggtggaggccaggctaccacctttgctgataagtacgctgctaatggaggccagactgctgctaatggggctacaaaccttggcgccagcgctgacagcccaattgatgtcatccctatatcagcttacaggccgacaccgccacctgttataccactggacgacgatgacgatgacaatgagcatttcactggcaaccagacatcagcatctgggcggaagatcaagaggccgtcccacctaagtggatataagatgagcggcggtttgggcagtgatgacaacaatggtgtgaagaccaaacgcaacaagacctctcacaggaaggctggtgctgacaatgagtttacctcggtgcccctttcatccagcaatcccagggaggctgtggaagaggttctcatgaacttcgaggccctgcggcgtagacatcttcaattggatgcggcacaagagagtaccaaacgcccagaccttaagattggtgccgtgatgatggccaataatcttagggctaacatcaggaagaggattggagttgttcctggagttgaaataggggatattttctacttcaggatggagctatgcattattggcttgcatgctcctaccatggctggaattgattatatgacccacacctttggtgataaggatgatgattctgtagcagtatgtattgtcgctgcaggtgtttatgagaatgaagatgatgctacagacacactagtctacagcggttcaggaggtagtagcaagaacaatgaggagatgcatgaccagaagcttgagaggggtaaccttgctcttcagatgagcctgtcgagaaagaatgtgatccgggttgtacggggatttaaagatccaggtagcttgggtgggaaggtttatatgtatgatggcctctataagatccatgagtcctggaaggagagaacaaagactgggatcaattgcttcaagtacaagctgctgagggagccaggacaacccgagggaatgtcaatctggaagatgtcccggaaatgggtagagaatccagcaactagaggcagagttctacaccctgatctatcatctggtactgaaaatcttccggtgtgtcttgtcaatgatgttgacagtgagaaaggaccaggccttttcacctatattacccaggtcaaatacccaaagccactaagttctatgaaaccattacagggttgttcatgcctcaatgcttgtctgcccagtgataccgattgtgattgtgcagagtttaatggaggtaatttaccttatagttcaacaggattgcttgtatgccgcaagaataggctatatgaatgtggtgaatcttgccagtgttcagttaactgccgtaacagggtgacacagaaggggattagggttcactttgagatctttaggacaggaaatcgaggctggggtcttcgttcatgggatcctatacgggctggctcatttatctgcgagtatgttggcgaggttattgatgagagtaaaaggaatttggatggtgaagatgaagatgattacctttttcagactgtgcgtcctggtgagaagacattaaaatgggattatgtacctgaactgatgggggagcaaatcacaaataattcagctgatacttttgagccactgcccatcaagataagcgcaaagaaaatgggaaacatctcacgtttcatgaatcatagttgctcccctaacgccttctggcagccagttcagtttgaccatggagatgacggtcacccacatatcatgttctttgcgctaaagcacatccctcccatgacagagctgacttatgactatggtgagattggagctgattctggtggtataggttctcctggagctaagagatgcctttgtggatcctcaaattgccggggctatttctgctga

SEQ ID NO: 944 - DNA, 915 bp, Triticum aestivum
atgggcaaccaagaacttcttgagtatttcagtgattatgctgcgaccaaagcacgccatgcatatggtccaggtgggcaccgtggcatgagtgtgctaatatttgaaagctctgctgtgggctatatggaggcagaacgtcttcataagcattttattgatcaaagaacagacagggacacttggcagaatcgcagggttcctttcttacctggtgggaagagacaattatacggtttcctagccagaaaggaagacatggagactttcaatagacactgccaagggaaaagccgcctgaaatacgagatgagatctcataatgagatggtagtggcccagatgaagcaaatgagcgaagataatcaacaactcaattatctgaagaacaaggtggttaagacagagcagcgctctaaagttgtagaagaaaccctgggtgttattacgcagaaacttcgagagactatggaagagaatatattcgtcaggagtaaagctaaagagaagcactctgagtatgaggaagagatgaaatcccaggaaaaattcttccatgatcagatagagaacattcacaaggccacagaagacaaggaaagcgagtttgagagattgctgcaggaggagcgtgcaaaggctagacagtgtgatgtggattctgggactactgaaaatcgcaggctaaggaaggaacaggtacagcggttcatagagtgccaggttaaggacgtgcaggagtttgaggctgaaagggacgaaatgataaaagcgcacgaggagaagaaggtgcagctgaagaaagagtacatggcaaaggaggtggagctcgagaaggagtttgatgctgctctcaccggtttgatggagaaacataggccaggcaccttccaggcctccagctccagcccgtga

SEQ ID NO: 945 - DNA, 3270 bp, Triticum urartu
atggcgacggcggtgtcagcgcccgtcttcacggcgacggtgcgggtttccaatatcccgccctccgccgtcgctaaggagctcctagcattcttcgattccgccgtcgccgctgccggcgaagcctacgcctgcgagatcgccgccgcccgacgcggctgcgtccgcgtggaggtcatcccggggaagcggcgcatagacctgtacctcaatcacgattcccagaggtacaggcttgaggtgtacttcgaggacatcaggaactgtctccagtgcagcttcgatggggccggcgtcatcttgcttcaggacctgtcggaaggcgtcactcctctgaagatcaggttattcctctccgtccagatcgaccacgctgctgtggtgaacacttccatgatcacggtgttggttctgaatgttcagaggctgcagcagctcatgtatgcaccaaggatatgcacaacaatttctgggcctgcagtttattcaaggttctcagatgaccgctttcatgcatgcaaggaggatgcaaaatttacctgggtcagagcactagattttacacgcaaccactcttttgggaagtgttcaactcttgccctcgtacttgatgaaggtgcaccggtgtcatttattctcaacagcttgcctatgtcaggagaattaggggaattggtcatttcttcaatggaattttttggcccgtcgtccaaagtcgttccccttgttgactgcccaagtggttgttcagtgtcatatgaagttctttttcgtctcaattctcttgttcacatggggaagatagtttccaaggatgttaatgccgatctgtttaaagctcttgaagaaataccagttcatatttcaaggaggatttttgagaaaatgaacaagttagactttacatgctatgaacctttgcaattcatccagcaggaggctcatagcaggaagaggagccatgatggtttgctttccagtaagactgaaggtgaaggaaagttaatgatgtgttacagaattcacatcactccatccaaaatatactgcttgggacctgaggaagaggtttcaaattatgtggttaagcatcacaaacagtatgcttctgactttgctagagttacttttgtagacgaagactggagtaagctttttccagatgctatctcagctagaactggacgagggttcttttctcaccccttgaaaactggcctatatcatcgtattttatccatcttgaaagaaggattttccattggtccaaagaagtatgaattcctggccttctcagcaagtcaacttcgtggaagttctgtttggatgtttgcctctaatgattccctgaaggccgaggatataagcaggtggatgggcaactttgaagatattcgttcagtatctaagtgtgcggctagaatgggccaactgttcagctcctccagacaaacacttgaaatcctaccacgggacgtagaagagattccagatatcgaagtcataactgatggcagtaaatatatattttctgatggtatcgggaagatctctgagagacttgctaaagaaatggcttgccgaattggattagactataccaaccctccttcagcttttcaaataaggtatggtggctacaaaggagttgttgctgtggaccctgattcctttcgtaatctttctctgcgacctagtatgaagaaattcgaatcaaagagcagaatgtttaacattacaagtaccagcaaatcccaaccatgctatatgaatcgtgaagttatctctctcctttcaactttggggataagagatgagatatttgagtcgatgcaacagaatgatatgcgtgaattagatgaaatgctgaccaacagagaagctgctctctctgttctggggaaaattggtagtgcagaaacaaagacagcatcgaaaattttactgcaaggctatgaaccaagtttagagccttacctgttgatgattcttaaggcccatcaggataataggctgactgacataagaactagatgtaagattcatgttccaaaaggccgtgttcttattggttgtttggatgaaacaggtgaattagaatacggtcaagtgtacatcagaattacaaagaacagcaaagagcagaaggataattgtcagccatattttgctgaagataatggaaaagagaaaacagcagttgttgttggaaaagttgcagtatcaaaaaatccttgtctccatcctggtgacatcagagtacttgaagctgtctatgaccatggtttgtacgctaagaacctggttgattgtgttgtcttcccccaaagaggagaaaggcctcatccaaatgaatgctccgggggcgatttggacggtgacctctattttatcacttgggatgagaaactgattccagagaaggttgattcacctatggactacactgcagcaaggccacgcataatggatcatgttgttacacttgaggaaattcagaagtactttgtggattacatgataaatgactcgctcggtgcaatctcaactgctcacttggtccacgcggatcgtcatccaatgaaagcccggagccctgagtgcctccagctagctgctttgcattcgatggcggtcgactttgccaagacaggagctccagctgaaatgccccggtcactgagagcaaaggagtaccccgacttcatggaacggtgggacaaaccaacgtacatctccaacggcgctctcggcaagctctaccgagcggctgcgagccgtatgcagagcgctcctgccccctcgtcctcggctcaatctagccccgcgttcgatcctgacctagaggtccctggcttggaggaattcctggcatccgcggaggagttctacgacctgtacgcggagaagctgagcaccctgatgagctactatggtgcggagcatgaggacgagatcctgacgggcaacatccggaataggctcctgtacctgaagaaggacaacaagaggtacttcgagatgaaggaccgcatcatcgactcggtggagggcctgcacaaggaggtgcagggttggttcaggagccgcccaaaggcagaggcgtcaaggtgggcgtcggcgtggtaccgcgtgacttatcacccggagcaccgacggccgggaaagaagcagttctggagcttcccgtggattgtctgcgacgagctgctgaagatcaaggagtccagtatgcggcgcaggcagcaggtggacgacgcggcggcctga

SEQ ID NO: 946 - DNA, 1890 bp, Triticum aestivum
atggagtcgtcacgcggcatcctcatccccggcacgccgccgctgccctacgcgtacgagccgctgccctcctcctccgccgacgccaacggccaggaggaccggcggatcaccggcggcgtgaggtggcgcgcgtgggccgccgtgctggccgtgggggcgctcgtcgtcgccgccgcggtctttggggccagcagggtcgaccgggacgcggtggcctcctccgtaccggctacagcggaacatggcgtgctggagaaggcgtccgggccatactccgccagcggcggcttcccgtggagcaacgccatgctgcagtggcagcgcaccggctaccatttccagccggagaagaactaccagaacgatcccaacggtccggtgtactacaaaggatggtaccacttcttctaccagcacaatccggggggcaccgggtggggcaacatctcatggggccatgccgtgtcgcgggacatggtccactggcgtcacctaccgctcgccatggtgcccgagcactggtacgacatcgagggtgtcctcaccggatccatcaccgtgctccccgatagcagggtcatcctgctctacacagggaacaccgagacgttcgcgcaggtgacctgcctcgcggaggccgccgacccaagcgaccccctcctccgcgagtgggtcaagcaccccgccaaccccgtcgtgtacccgccccctggcatcggcatgaaggactaccgcgaccccaccacggcgtggttcgacaactccgacaacacgtggcgcatcatcattggctccaagaatgataccgaccactccggcattgtattcacgtacaagaccaaggacttcgtcagctacgagatgataccggggtacctgtaccgcggccccgccggcaccggcatgtacgagtgcatcgacctgtacgccgttggcggtggccgcaaggccagcgacatgtacaactcgaccgccaaggatgtgttgtacgtgctcaaggagagcagcgacgatgaccggcgcgactattacgcgctcgggaggttcgacgcagcggccaacacatggacgccgatcgacaccgagcaggaactcggcgtcgcgctgcggtacgactatggcaggtacgacgcgtccaagtccttctacgaccccgtgaagcagcggcggatcgtctgggggtacgttgtcgagaccgactcctggagcgccgacgccgccaaggggtgggccaacctccagtcgattccgagaacggtggagcttgacgagaagacccggacgaacctcatccaatggccggtggaggagctcgataccctccgcatcaacaccaccgatttcagcggtatcactgtcggtgccggatccgtcgtctccctccccctccaccagacctcccaactcgacatcgaggcatccttccgcatcaacgcctccgccattgaggccctcaatgaggttgacgtcggctacaactgcaccctgaccagcggcgccgccacccgcggcgcgctcggccccttcggcattcttgtcctcgccaatgtcgccctgacagaacggacggcggtgtacttttatgtgtccaagggactggatggtggtcttcggacgcacttctgccacgatgagttgcggtcgacacatgctaccgatgtggcgaaggaggtagttggtagcacggtaccggtgctcgacggcgaggatttttccgttagggtgctcgtggaccactccatcgtgcagagcttcgtgatgggcgggaggatgacggcgacatcaagggcctacccgacggaggccatttacgcggcggcgggggtctacctgttcaacaatgccaccggcgccagcatcaccgctgagaagctcgtcgtgcacgac

SEQ ID NO: 947 - DNA, 907 bp, Triticum aestivum
gaccgcatccgaatgaatgttcagggagtgatctggatggggacatatactttgtttcatgggacccagatctcattccaactcgtatggtggcgcctatggactatactcctgcaccaacagaaacattagatcatgatgttatgattgaggtattttatgtttgtagcccagattgttcatttttcatgccattcaccttcacgataacgtctgtacacctgttggctgttgccatgaactgtcatttagtcgtgcttctgattgtgaatttcctttcgattctggttcttgcatttctgaagagttgactacttaaacctgttttctgagtctgcagggttttaatttatttgtttgtacttccgccagtccaaaatgtagatctttttatagttgagcacatgaactaggggtggtggtaacatgccaatgttacccttcattcatttcatgtgctctctgttccttccaatagagtagtgctacagtataggctcaattcttgatgaaactaatgtgggactagattggaacacatgagaagtgtattgcgaatgtagaaggacctacattttggatggaattgaaaagactagaaggacctacgttttggatccgaggaagtaggaagataaatctgtttcttctcattgtctattacttgcaaggaaattccaagcatcttgtaaaacaaatctgacaccctgctttggaaccactctaatatcatgcaggaagtacatgagtatttcacaaattacatagttaacgagagtctgggaatcattgccaacgcgcacgtagtctttgcggatagggaaatcttgaaggctgaaagtacaccatgcattaagctggcagagctcttctccattgctgttgatttcccaaaaaccggagtccc

SEQ ID NO: 948 - DNA, 3231 bp, Triticum aestivum
atgctccggaatggaaacgagggaatgtccacaatacccggatttagtcagatccaattcgagggattttgtaggttcattaatcaagccttggcagaagaacttgacaagtttccaacaattaaagatccagatcacgaaattgcatttcaattatttgcgaaaggatatcaattgctagaaccctcgataaaagaaagagatgctgtgtatgaatcactcacctattcttccgaattatatgtatctgcgagattaatttttggtttcgatgtgcaaaagcaaaccatttctatcggaaacattcctataatgaattccttaggaacctttattataaatggaatataccgaattgtgatcaatcaaatattgctaagtcctggtatttactaccgctcggaattagatcataagggaatttctatctacactgggactataatatcagattggggagggagatcggaattagcaattgataaaaaagaaaggatatgggctcgcgtgagtagaaaacaaaagatatctattctagttctatcatcagctatgggttcgaatctaagagaaattctagataatgtttcctaccctgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaaggattggtcgacgaaatatgaatcggagacttaatcttgatatacctcagaacaatacattcttgttaccacgagatgtattggccgctacggatcatttgattggaatgaaatttggaacgggtatacttgacgatgacgatatgaatcacttgaaaaataaacgtattcgttcggttgcggatctgttacaagatcaattcggattggctcttggtcgtttacaacatgcagttcaaaaaactattcgtagagtattcatacgtcaatcgaaaccgactccccaaactttggtaactccaacttcaacttcaattttattaataactacttatgagaccttttttggcacatacccgttatctcaagtttttgatcaaacgaatccattgacacaaactgttcatgggcgaaaagtgagttgtttaggtcctggagggttgacggggagaaccgcaagttttcggagccgagatattcatccgagtcactatgggcgtatttgtccaatcgacacgtctgaaggaatcaatgttggacttactggatccttagcaattcatgcgagaattgatcacttgtggggatccatagagagtccgttttatgaaatatctgctgagaaagcaaaagaaaaaaaagagagacaggtggtttatctatcaccaaatagagatgaatattatatgatagcagcaggaaattctttgtccttgaatcaaggtattcaggaagaacaggttgttccggctagataccgtcaagaattcttgactattgcatgggaacagattcatgttagaagtatttttcctttccaatatttttctattgggggttctctcattccttttattgagcacaatgatgcgaatcgggctttaatgagttctaatatgcagcgccaagcagttccgctttctcggtccgagaaatgcattgttggaactggattggaacgccaaacagctctagattcgagggtttccattatagccgaacgcgagggaaagatcatttctactgatagtcataagatacttttatcaagtagtgggaagactataagtattcctttagttaaccaccgtcgctctaacaaaaatacttgtatgcaccaaaaacctcgggttccacggggtaaatccattaaaaaaggacaaattttagcagaaggagctgctacagttgggggcgaacttgctttaggaaaaaacgtattagtagcttatatgccatgggaaggttacaattttgaagacgcagtactaattagcgaacgtttggtatatgaagatatttatacctcttttcacatccggaaatatgaaattcagacggatacgacaagccagggctccgctgaaaaaatcactaaagaaataccacatctagaagaacatttactccgcaatttggacagaaatggagttgttaggttgggatcctgggtagaaactggtgatattttagtaggtaaattaacgcctcagatagcgagcgaatcatcttatatcgcggaagctggattattacgggccatatttggccttgaggtttccacttcaaaagaaacttctctgaaattacctataggtggaagagggcgcgttatcgatgtgaaatggatccaaagggacccgctcgacataatggttcgtgtatatattttacagaaacgtgaaatcaaagttggggataaagtagccggaagacatgggaataaagggatcatttccaaaattttgcctaggcaagatatgccctatttgcaagatggaacacccgttgatatggtcttcaatcccttaggagtaccctcccgaatgaatgtgggacaaatatttgaaagctcactcggattagcgggggatctgctaaagaaacattatagaatagcaccctttgatgagagatatgagcaagaggcttcaagaaaacttgtgttttcagaattatatgaagccagtaaagaaacaaaaaatccatgggtatttgaacccgagtacccgggaaaaagcagaatatttgatggaagaacaggcgacccctttgagcaacctgttctaatagggaagtcctatatcttaaaattaattcatcaagttgatgagaaaattcatgggcgttctactgggccctactcacttgttacacaacaaccggttagaggaagagccaagcaagggggacaacgagtaggagaaatggaagtttgggctttagaaggatttggtgttgctcatattttacaagagatacttacttataaatctgaccatcttatagctcgccaagaaatacttaatgctacgatctggggaaaaagaatacctaatcatgaggatcctccagaatcttttcgagtgctcgttcgagaactacgatctttggctctagaactgaatcatttccttgtatctgaaaagaacttccaggttaatagggaggaagtttga

SEQ ID NO: 949 - DNA, 3507 bp, Triticum urartu
atggagatggccttatgccacgtcagcccgatacaattgggggcccctgccgttaacctaccgcccatgggctcgtcggtagaaagagggttagattccgaaataattttgaataagggtcaaatccggctaaacttcagcaaaaaggcgggtcgatgggctgcccaggctttgttaggagcagcttttgtctgcttgttcaggcatgccaatgccgtgccatggcaggtcaggtcagattatcaagcgcaaacgcgcgtgttcttcttcttcgtggtgccgtttgatgaggtcatgagcttgagcgaggagggtggcgggacgacggacaagatgggcaagcaggacaacgacgtctcccgcgccgtcgtggaggacgacaccgcgctcctcctcgcggcggtggacagcatcaagaaggcggcgctgggccggctgcgcaacggctccgacgccgccaggatcctcgaccaggacatgtccaacaggctcctccacctcgcctgcaggcacgacgccgccgagtgcgccaggctcctcctcgacggggagtacgggatcacgccggcctccgtcgacgccagggacccgctcacgcggacgcccctccacgtcgctgccgaggggcactccaagaggtgcatccagctgctcctctccaggaacgcccggacggacgtcaggctgctcgatggcacacgcctagtcgcgctcgaggtcgcgctcatgagcagaagggttcaagttgattggtcacaggacaactcggtcgaggatcttcttgcttatctgcaacaaaaggatctgaacgcggtgaggcttctggcagagaagaccagggaggttggggaggtggcttacagatacgccatggaggggcgtgtcgctgcactcgcaatgctgctcctggtgactgaggaaaggatatcggcgatggtgagcgtggtgattgatggcgtcaggacaaagagatcaatctacaactctgttgtggacgaggttctgtcgattggagaggcttcagctagagaaggcaatgaaatgaggaggaaagccttgctctgtgagattcagctgcttaaccaatttggggccacagtgtggagggaccgaaaagttgacaggagaagcttgccccctctacttagggctgcaaaggccggagatatgaatgtcacaaagatgcttctgatgggggatgttgatgtcaatgaaaccgaccccgaaggaaacacagcacttcactggtgccttagtagtagctcaagcacacaggagccaaggattgtgtggctcctgcagaagaatggtgccagagttttccaggggaacaaactaggtctcacaccagtgcacagcgctgcagctaagggcaattacaaggctcttcagtcacttctgcttcatgcacaagattgcgttgatataccttccaagaccaaagaaaccccattattccttgcagtgaaaaatggttctttgagctgtgtacgacttcttttgcgttatggggctaaccccaaagcccagaacctacgaaagcaaagaccaatagacgtggcgacatcccaggacatgcggttccttctcaactccgcaaatgttgtaccaatgaaccatggctcaatggaaaagaaccatgcaatgaaaaaagaaaggcacaaagagcttctggatgatgatttcgatgattgtgacaacgacgattattatgaaagctatgttgtgccaaaggcgtcagtaggtcaccgggattttcgggttaaaagtaagggccacagtaccccgaaagaaggccccaaattatctcggcataatgatcattgggagaagcatgactacactcgcaaaatctttgttgggggtctcccgctttcagtagacgatgcgtaccttagcaaattcttcagtactgaattcggacctgtggaggaagcaatagtcattaccttaaaaatagacgagaggatacagtcccgaggctttggctttgtaaaattcaaaagagagaaggatatgattagtgcaaaggaagctcatcatgtctatgtgcttgggaagagagtggagataaaggatgctgttgctagaccgtccctgcctgaactcgaaagagcaacttccttcaggcaccatgtacgtgagtccccaagagtgactcatagtgagctggaggatgaacaagctgagcaatataactttggaaaacggcggccaatgccagagaagcacctcccgtcttggttcttcatattcaggaggtggttgccaggatttctcatggaagcaaccgagcgatatggggagaagtacccattatgctctgtgaagactgatttcagatcatgttgcagaatggagcttgatcattctgcccttggctatcctaagctaagcgatttcatgcgctccctccctggcatatgcaggatgcgtgtagtccctgtaggaaatggccctgcaacacatatggtccttctgccacccctctcaaggccaaagtatgtacccttgctggagccttactcgtttgatcatgacgagctcccagaatcagtgtcagatcatcactctccaagatcaccacttaccgccaatatcactgagaatgctccttatagcactgacagtccacagggtgatgcatgcagcgagaccaatgtccagagccagcatgatgatgagtgtagcagaagcaatggcgaaagcctgccggatggtgattccacctccaattgtagcttacttgatgaggttactgtgagcacaccaaagtctgatttgatcgagtcacctgcaagaaagcctgatttgatcgtgtctggagctcttcctggaaaagccgaacaaggaccgttaaggaggcctgatttggtcgagtctgcacctacaaagaaactcgatttgattgagtccagtcctcctccttctcctcctagcaaggctgatttggttcagcctgggcctgcagggaagcttcatttggttgagtccagtcctcctaggaaggctgaattggttgagccgggaccagcaaggaagattgatttgaatcaacccagaccaacaacacgctttgttgatcgtcctgttgaaaggccagcaatcactccaagcagctgcgagaatgaaatgagattctccttcttccactcacagtgggacaagtacctaactccacatgccaagagtgactactgcatcatatgccgctcctgtgaggccgcgatggagcttgtcccgtgcctccataagatatgtgttgcctgcatgatgaggtgcaatgtcagggcatgcatgacctgtggcactgctggagtcatggagtgcgtctcggatcaaaagtgccagttgatggttgtctgcagtggagctgatgcagttgtgagatgctccccctgcatgcacaccatagcttgccgaggctgcctcctggcctcggtgacactgctcaagaagtgcactgtctgtgactgcatgattgagcacttcaagtttggtccataa

SEQ ID NO: 950 - DNA, 2052 bp, Triticum aestivum
atgattgaccaatataaacatcaacaacttcaaattggactcgtttcccctcaacaaataaaggcttgggctaacaaaaacctacctaatggagaagtcgttggcgaagtcacaaggccctctacttttcattataaaaccgataaaccagaaaaagatggattgttttgcgaaagaatctttggacccataaaaagcgggatttgcgcttgtggcaattctcgagcgagcggagctgaaaacgaagacgaaagattttgccaaaaatgcggggtagaatttgtggattctcggatacgaagatatcaaatgggatacatcaaactcgcatgtcccgtgactcatgtgtggtatttgaaaggtcttcctagttatatcgcgaatcttttagataaacctcttaagaagttggagggcctagtatacggcgatttctcttttgctaggcccagcactaaaaaacccacttttttacgattacgaggtttattcgaagaggaaattgcatcctgtaaccacagcatttctccctttttttctaccccaggctttgcaacatttcgaaatcgggaaattgcgacaggagcaggtgctattagagaacaattagcagatttggatttgcgaattattatagagaattctttggtcgaatggaaggaattagaagacgaggggtatagtggagatgagtgggaagatagaaaaagacgaataagaaaagtttttttgattagacgcatgcaattggcgaaacattttattcaaacaaatgtagaaccagaatggatggttttgtgcttattaccggttcttcctcccgaattgagacctattgtttataggtctggagataaagtagtgacttcagacattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccgacgagggatggtcacaataaagtatacaaatcactttcagatgtaattgaaggtaaagagggaaggtttcgcgagactctgcttgggaaacgggtcgattactcggggcgttctgtcattgttgtgggtccttcgctttcattacatcaatgtggattacctctagagatagcaataaagctttttcagctatttgtaattcgcgatttaatcacgaaacgcgccacttctaatgtaaggattgctaaaaggaaaatttgggaaaaagaacccattgtatgggaaatacttcaagaagttatgcggggacatcctgtactgttaaatagagcacctaccctgcatagattaggcatacaggcctttcaacccactttagtagaggggcgtactatttctttacacccattagtgtgtaagggtttcaatgcggactttgatggagatcaaatggctgttcatctacctttatccttggaagctcaggcagaagcccgtttacttatgttttctcatatgaatctcttatctcccgctattggggatcctatttgcgtaccaacccaagacatgcttatcgggctttatgtattaacgattggaaagcgtcgaggtatttgtgcaaatagatataatagttgcagaaactatccaaatctaaaagtaaattacaataataataataattctaaatataggaaagataaagaaccccatttttctagttcttatgatgcactgggagcttatagacaaaaactaatcagtttagatagtcccttgtggctacgatggaacctggatcaacgcgtcattgggtcaagagaagttccgattgaagttcaatatgaatctttggggacttatcatgagatttatgcccactatctaataatgggaaatagaaaaaaagaaattcgttcgatatacattcgaaccactcttggtcatatttctttttatagagaaatagaggaagccatacaaggatttagtcaggcctattcatacactacctaa

SEQ ID NO: 951 - DNA, 4209 bp, Triticum urartu
atggagcaagcgtgtcggggtggagaaagaaggttcatcaatgcccattttagagttttgacttgcgacaccgatactagagccaaaaatacggagttcaagcgtcataatgttgatgatctcatgatggaggagccaaatgctgaaatgggaatgccaaccggggagctgaaaggcatcacattctatctcatgaccaatacagagatggaaaagtcaagcagcgtgagcattgtagaaccatctgatgtcagtagtgccaagttgggactaccaaatggggcaccacagtgtgagacttgcggagcgcagagtgtgcgtgaatgtgatggtcattctggcgtgattaagctgccagcaactgtgttcaacccgcatctattcgaggaagttgttcagttactgaatcagatatgtcctggctgccacactccaaagcagaacagagattcaaagaggtcggatggggcaacaagtcaagcaacttgcaagtattgctcaaaggatggcactaaacaataccccgatgtaatctttaagacactgacaagcccaagaatgacactgtccaaggctaaacttcaacgggatcctagcgttatggacaaaatttcgcttactgcagaagttgctgacagagtgactgattcagctgaagttcttcccctggactattgggatttcgtacctcatcaccacccccctcaatcaaatatgaccaagatattactgtctccataccaagcctctcacatattgaaacaacttgatcctgagctatttagccggtttgcttcaaggccggagctaattttcctgtcgtgtttgccggtcactcctaacttccatcgcgtggcggagttgccctatgggttttcagatggccctcgcctagcttatttacactctaaaaagacagataaggagtcatcaacagacacacatggaatgaaatggttgaaggatgccattctcagcaaacggtccgataatgcttttcggggtactatggtcggtgatccgaagattagattgcatgaaattggcatccctgtggatttagcttcgaacttgttagtttctgagcatgtgaactcctacaactttgacagcataaattcgaagtgcaactgttaccttcttgccaatgaaaaactagtcattaagcgcagtggaaagacaattattgttcggaagccaaatcagctggtaattggtgacactgtgcacaggctgttgcaggatggtgaccttattcttatcaataggccaccgtcaatacatcaacactccgttattggactctctgcaaaattactcccagttcagtcggtactttcaatcaacccactctgttgtgcaccactcgcgggagattttgatggggactgtttgcatggatatgtcccacagtccatacagtcaagagttgagcttgaggagctagttagtttgagccaccaactattgaacgcgcaagatgggcgaagtttggtgtcattaacacatgactctctagctgcagcatatctgttaacaagctcagaggttttactaaagaaaactgaagttcagcaatttcaaatgttattatgccatccactctcgccgacaccagggccagcaataatgaaatctatacactctcatggtccactgtggaccggtaagcagttgttcagcatgctgcttccgtctgatatgagtttcagcattgagcctaagaatagcatatctggccttttttccgtcatgttcaaacaatatggcgacaaggctcttgagttactctcttctgctcaggatgtactatgtgagtttttaaccatgagaggtttaagtgtcagtctttcggatatctatctgttcccagaccatgactcgaggagaaaactagctgatggagttaatctggcattggatgatgctgaagaggcttttcgtattaaacagatattgctaagtccagattccatatcgattctgaaatgttatgacgactgtgctgatttatcacaatcttatgaacagtccaatttcattcagagcaatctgccaattataaaatcttcaatcatggcgtttaagagtgtattcagtgatcttcagaagatggttcaacagcacacagccaaaaataattcaatgatgatgatgactaatgcaggaagtaagggtagcatgttgaagtttgtgcaacaaactgcatgcgtcggtcttcaacttccagcaagcagattcccctttagaattccatcggaactctcatgtgccagctggaataggcataaatctgagggcacgggtgaatgcttgggaggccaaaacttgtatgctgtgatcaggaattcctttgctggtggtttaaatccattggagtgtcttcttcattcgatatctggcagggcaaacttcttcagtgagaatgcagatgttcccgggactttaacaagaaaactaatgtatcacctgagggatttatatgttgcttatgatgggactgttagaagttcttacgggcagcagataatgcagttcacttatgatactgctgaagacatgtgcagtgatcgcaatgtggaaggtgaacttggtgcccctgttggttcatgggctgcttgttccatttcagaagctgcatatggagctttggatcacccagtgaacagcttggaggaatctcctctcatgaatttgcaggatgtattgaagtgccagaagggtggtacttctatggatcatgttggtttgcttttcctgtcaaagaatctaaaaaaatatagatatggtttggagtatgcatcgctagaagttaaggatcatctcgagccagtgaacttctctgatttggttgacaccgtcatgatcctatatgggggatgtggtatagagtcaacaaaaggaagcgcatggattactcattttcatctaagccaggaaatgatgacgaaaaaaagattgggactaacacttgttgtggaagagcttacagaacaatacaatgccaaaagagacaagttaaacttccctaaagtttatatttcaaagggggtaaataccgctgggaagatggtcaggcggctgtttgggagagggattagattagggattgcgaggatgagcaaatgttctgctgacaatgagtgcggtaacaggcagacttgttgcatcactgtggtaacacaggatgattcaaactctatgtctcaattggacactatcaagaaaagggtgattccaaacctcctggccttactagtgaaaggatttttggaatttaagaaagttgagatccagtgtcaagaggacagtgaacttgttgtgaaagttgttatgtctgaggagcattgcaagagtgttaagttttgggctactctacaaaagtcttgcatagcaattatggagttgattgactgggagcggagccggccagggagcgtatatgatattttctgctcatatggcatagactcagcgtggaaatactttgttgaatctttaagatcaaaaactgatgatattggaaggaatattcgccgcgaacacttgctggtcgtggcaaattgcctgtctaggcctgcacatacttttataaatgctgcaaagcagtcttcagtggacaatctctgtggtactgtagatgcaatggcctggggcaaggagccttctactgggacatcgggtcctttcaagattatttattctgggaaggcgcatgcacccataccaaatgagaacatctatgacttcctaaatagccctgaagttcggcaagcgccgggcgaagctttcttgaatggtagcaccatatctgtggagcaagattttcttgttgctgcagttggtatatgggacagcattattgatatgcgcacttgcttgcagaacatgctacgagagtaccaattaaatgaatgtgttggggagctagataaatcacgtgtaatcgaggccctgagatttcatcccagagggcgtgaaaagattggtgctggaatagaagatataaagattggacatcatcctagtcacccaggaacaaggtgcttcattatggtgaaagcttatgttcggatccagaatgacgatggcggcaccctcgacgccatccctctgtttggagcatcgtatttggagacatggcttggaggttctaagttgcgttcctatggtgcgcgctgctgttatggaccgttctcaagggtctag

SEQ ID NO: 952 - DNA, 1581 bp, Triticum urartu
atggccggcggcgcggttgtgaacaccggcggggggaaggactaccccggcaagctcaccatgttcgtgctcttcgcctgcatcgtcgccgccaccggcggcctcatcttcggatacgacataggcatctccggtggcgtgacctcgatgaaccccttcctgatgaagttcttcccgggcgtgtaccaccaggagcaggaggcggagcggaaccagagcaaccagtactgcaagttcgacagccagctgctcaccatgttcacctcctcgctctacctcgccgcgctcgtcgcctccttcttcgccgccaccgtcacccgcgtcgccggccgcaagtggtccatgttcgccggcggggtcaccttcctcgtcggcgccgcgctcaacggcgccgccaagaacgtcctcatgctcatcctcggccgcgtcctgctcggcatcggggtcggcttcgccaaccagtcggtgccggtgtacctgtcggagatggcgccggcgaggctgcgggggatgctcaacatcgggttccagctgatggtcaccatcggcatcctgtgcgcgaacctgatcaactacgggacggccaagatcaagggcgggtggggctggcgcgtgagcctcgcgctggccgcggtgcccgccggaatcatcgccatcggcgcgctcttcctccccgacacccccaactccctcatcgaccgcggctacacggaggacgccaagaagatgctccggcgcgtgcgcggcacggacgacgtggaggaggagtacagcgacctggtggccgccagcgaggagtccaagctggtgagccacccgtggcgcaacatcctccagcgccgctaccggccgcagctcaccttcgcgatcgccatccccttcttccagcagctcacgggcatcaacgtgatcatgttctacgcgcccgtgctgttcaagacgctggggttcgcggacgacgcgtccctcatgtccgccgtcatcaccggcctcgtcaacgtcttcgccaccttcgtgtccatcgtgaccgtggaccggctgggccggcgcaagctgttcctgcagggcggcacccagatgctggcctgccagatcgtggtgggcagcctgatcggcgccaagttcgggttcaccggcgtggccgacatccccaaggggtacgcggcgttcgtggtgctcttcatctgcgcgtacgtggccgggttcgcgtggtcctggggcccgctggggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggcgcgtgggtggtggtcatgaccctcttcgtcgccttcttcctgccggagaccaagaacgtgcccatcgaggagatggtgctcgtgtggaaggcgcactggtactggggccgcttcatccgcgacgaggacgtgcacgtcggcggcgccgacgtcgagatgcgctccaacggcaagctccaggctgccaagctcccgtga

SEQ ID NO: 953 - DNA, 4878 bp, Triticum urartu
atggcgaccgttccctctgtaaccgcgcctgcccctatttgggccatttccgccgtatttcctcccgtgtatcatactcatctcttcggatgtgcgtcgtgggggcttagcttgctgggggttaggagactattttcagaaatccgttggagtacttgcatacttagtggatccgtgcttggtggcattgagattcaccgcaaatcttctgtagccttaatttgccttgactgcctgcagctggtgatttttgttcttgagtatcctagggatatatcaaatatggtgaaaagtccacgttctccagttaccacaggaacaaaaaggtgcagagcaaagccacaaaagaagggtgaagaattcactgcacaaggaaaattggtggatgggcctcaggatgcaacaaatggtgttgaaaagggtgctggttctgctactcacaagaggccaaggagggcagcagcctgttctgattttaaggagaaatctgtacgtttatcagaaaaaacttctgttgtcaagatcaagaaaaatcggatggaagaggaagaaatagatgcaatcaacctgacaaaattagggccagaagattcgccgccttgccggaagttgattgatttcatcttgcatgatgcagatgggaatctgcagccatttgaaatgtctgaaatagatgattttttcataacagctctcatcatgcctatggatgatgatctagaaaaagagcgtgaaagaggtgtacgctgtgaaggatttgggcgtattgaggactgggcaatatctggttatgatgaaggtactgcagtggtctggctctcgacagaacttgctgattatgaatgtgtgaaaccagcaagcaactacaagtcttactacaaccacttctatgagaaggcacaggtatgtgttgaagtctacaggaagctcatgagatcagtaggtgggaatcctaacatgagtctggaagaattgcttgctagtgttgttcgctctgttaatgctatccaaggttacactggaacaatgagcaaagaattcatgattgccactggtgagtttgtatacaaccagctcattggtttggatcagacggcaggcaatgatgatgagaagcttgttacattgccagttcttcttgctctaagagatgagtgcaaatctcgagcagaatttaccaagatgccacttagcatttcaaatgggagcctgaagatcaaggatattgagtgtaaagaggtagctgaggacgatgatgagaaattagcaagattattgcatgaagaagaagaatggaagatgatgaagaaacagaggggtaaccgtggagtcccttcccagaaaaatgtctacatcaaaattagtgaagctgagattgcaaatgactaccctctgcctgcatactataaaccatctagccaggaaatggatgaatacatatttgatagtgaggatggcatgttctctggtgatgtgccagtaagaatcctcaataactgggctctatacaatgcagattctaggcttatttctctggaattaatccctatgaagtcaggcgcagaaaatgacatagttgtctttggatctggttttatgagagaggatgatggcagttgctgttccacagctgagtctgcaaagttgtcttcttcatcaagtaaagctgataatcaggatgtaggagttccaatatatttgagcccaatcaaggaatgggttatagaatttggtggctcgatggtttgcataaccattcgaactgatgttgcttggtacaagctacggcagccaataaagcaatatgctccttggtgtgaacctgtactgaaaacagcaaggcttgctgttagcatcatcaccctgctaaaagagcaaagccgtgcttcaaagctttcttttgctgatgtcatcaagaaagtggcagagtttgacaaagagaatcctgcctttatatcgtccaatattgtactggttgagaggtacattgtggtacatggacagatcatacttcagcagtttgcagatttccctgatgagacaattcgacgtagtgcttttgccactggcctgttgatgaagatggagcagagaagacatacaaagttgttcatgaagaaaaaggctcaagtaacaagaggagagaatctgaatccaattgcaacaatgggaacatcatcaaaaagaaaagcaatgcgtgcaaccacaacaagattgatcaacagaatatggagtgattactatgcacaccatttccctgaagatttgaaggagggagatggaaacgaagcaaaagaagttgatgatgaacaagaagaaaatgaagatgatgatgctgaggaagaggtacagattgaagaagacaaggttgcaaagactccaccatcaacacggtctcgaaaattggtatcacaaactagcaaagaaatgagatggaagggtgatccagctgggaaaacaacttctggagaagctttatacaaatgtgcgtatgcacgggaactcagaatagatgtcggaggggcagtcacactggaagatgattctggagaaatagtcatatgctttgttgagtacatgtttcagaaatctgatggtgcaaaaatggttcatggaaggattctgcaaaaaggctcagaaactgttcttggcaatgctgcaaatgaaagggacattttcttaactaatgactgtttggagtttgaactaaaggacatcaaagaattggtctctgtcaatctccaatcaatgccttggggtcacaagtatagaaaagagaattctgaagctgagaagattgagtgggccaaagtggaagagaggaaaaagaagggtctgcccatggaatatttatgtagaagcctgtactggcctgagaagggtgccttcttctctctacctcgtgataaactgggtcttggtaatggtgtctgtggctcttgtgagcacagagaaccggactgtgatgaattaagaatacttaccaagaccagcttcatttacagaaaggtaacctatagtgtccatgacttcttatacattaggcctgagtttttctcccaagaggaggatcgtggcacctacaaggcaggaagaaacattggcctgaagccctatgcagtttgccatcttttggatgtctgtggacctgctggttctaaaaaagttgaccctgcatcaacaaaagtcagtgttcgaagattttatagaccagatgacatttcaactgctaaagcttatacatctgatatcagagaggtatactatagtgaagatataattaatgtgccggtggatatggtagagggaaaatgtgaggtccgaaagaagatagatatctcaaattcagaccttccagtcatgattgaacatgtattcttctgtgagcatttctatgattgtgccactggggctctcaagcagttgccttcaaatgtaaagctcatgtctgtggctcgcaaggcaactggtgctttgaaaaagaacaagggaaagcagatctgtgaaaataatgaagttgattcaggcaaatggatggaggtgcccaaagagagccgtattgcaactctcgacatttttgctggctgtggaggtttatccgaagggttgcagcaagctggtgtgtcatttacaaaatgggcaattgaatatgaggaaccagctggtgaagcatttaggcaaaatcatccggaagctgctgtgtttgtggataactgcaatgtgattttaaaggcaatcatggacaagtgtggggattctgatgactgtgtctcaacttctgaagctgctgaacaagcagctaaacttgctgaagagaatattaaaaaccttcctgtccctggtgaagtagaattcataaatggcggtcctccctgtcagggcttttctggcatgaacagattcaaccaaagcccatggagtaaagttcagtgtgagatgattttagcattcctctcttttgcggagtattttcgtcccagattctttcttttagaaaatgtcaggaattttgtttcgttcaacaaagggcagaccttccgactggcggttgcatctcttttggaaatgggataccaggttcgttttggaatcttagaagcaggtacttttggtgttgctcagtccaggaaaagggcattcatttgggctgctgctcctggagagattcttcctgattggccagaaccgatgcacgtgtttgctagccctgaactgaaaataacactgcctgatggcaaatactatgcagctgccaaaagcactgctggtggggcacctttccgtgcaataactgttagagatacaattggggatttgccgaaagtggaaaatggtgcaagtaaactcgtacttgaatatggaggtgagcctacctcttggtttcagaagaagatcagaggtagcactattgcattgaacgatcacatatctaaggagatgaatgaattaaatctcataagatgcaaacatattcccaaacgacctggttgtgactggcatgacctgccagatgagaaggtgaagctatcttctgggcaaatggtggacctgataccttggtgcttgcctaacaccgctaaaaggcacaatcagtggaagggtctgtatgggaggttagattgggagggcaatttccccacgtctgtgactgatcctcagccgatgggcaaggttggcatgtgcttccaccctgaccaggataggattatcacggtccgcgaatgtgcgcgatctcagggctttcctgacagctaccagttttcgggcaccattcagagcaagcacaggcagattggcaatgctgtgccaccccctcttgcctttgcgcttgggaggaagctgaaggaagccgttgatgggaagcaccagcaggcctga

SEQ ID NO: 954 - DNA, 2613 bp, Triticum aestivum
atggaccgatcgccggcacctctcagcccaccaggtttcgctgtgccgctcgccgtcaagaagcggcagcaggcggcgccaggctacagcagcagcagcagcccgtggggagtccctccggcgccgcccctcaccaacaacaacaaccccaacccgcccaatggcctcagagcaggcgacaccagcatcttctccacctcgctgcccgtactgccgcacgaaaaattgaacttccctgactctgcacatggcaccccttcgatggacgatgcgtcagcgaagcttaaagattttgatgatgatcctcaggggaacgactacccgtttgactttgatctccggcagatcgacgacctgctgcccgatgaagatgagcttttcgctgggatcacgaatgagatggagccatcttcgcaggcgaatcctgtagaggaactggaggagtttgatgtgtttggcagcggagggggaatggagctggactcagaccctctggacagcatcacagctggtttggggaatgcaagtataagtgatgggatcagggccaatggagtaaacaacaattttggcctgtcaaacagtcctggagctgtggctggggagcatccgttgggggagcatccttccaggacattgtttgtgaggaacattaacagtaacgttgaggactctgaactgcgctctctctttgagcaatttggggatatccggaccctttacactgcaacgaagcacaggggctttgtgatgatatcttattttgatatccgggctgcacgtggtgcgatgcgttcattgcagaataagcctctgaggaggaggaagcttgacatacatttttctatcccaaaggagaatccgtctgacaaagatttaaaccaggggactcttgttatctttaacttggatccatcagtttctaatgaagaagttcgccagattttcggaacttatggggaagtaaaggagataagagagacgcctaacaaaaagcaccacaagtttattgagttctacgatgttagggcggcagaagctgctcttcggtcactgaataagagcgagatcgctggaaaacgcatcaagttggagccaagtcgtcctggtggaacacgcagaagcttggtgcaacaccttggtcatgaactagaagatgaaaccagaggttataggcattctcctcacgttggatcgcctatggctaactctcccccaggggcgtgggctcaatatggtagtccaaccgacaacaatttgctgcatgcattcagcaattcacctactggaaacggaatgagccctatcggaatgtccccttcaatgatgtcaaatgctctgaagattgcaccaattgggaaggacaacaactggtctaaatacgatcaagtattctcaaacagcaaccagtcccttggcgcagcgtttcagtattcacagtcataccaagatcgcaaaagtgagcatatgagctcgagtcctgggactttaacagggcccgagtttctgtggggcagcccaaagccttatccagagcattcccaatcctcatcaatgtggcgtccaccaccagttggtcatgcaatgtcatccagtagccgccctcagggtcagggcttcctgtatggtagtcgccaggcttcattgttcggatctttggatcaaaaccgtcatcatgttgggtctgccccttctggcgctccatttgagagccactttggatttttgcctgaatcgcccgagacgtcgtttatgaatcaagttaggtttgcgaatatggggaacattggcggtgctaaccgaaacgggggaagcctcatgctgaacatggcttctcgtgcttccctgaatcctgtttctgctctaagtggaagcctgacagataataactctactaacttcagaccaataccatcgccaagacttgggcaaccaccattctttgggaacaccacatatcaagggcctggttattatggacttgacagctcctccattgagcgtggtcgcaaccgccgagttgacagcagcgcgttccaggcagatagcaagaagcactatcagcttgatttggacaagatccgtaaaggagaggatactcggacaacattgatgattaaaaacattccaaacaagtacacatccaagatgcttttggctgcaatcgatgagctccacaaaggaacatatgacttcttctacctgccaattgatttcaagaacaaatgcaatgtcggttatgcgttcatcaacatgatatcccctgtgcacattgtatctttctaccaggctttcaatgggaagaagtgggagaaatttaacagcgagaaagtagcatcattggcgtatggtaggatccagggaaggaatgcactaatctcacatttccagaattcaagtttgatgaacgaggacaagagatgccgccccattctttttcattccaacgggccagagactggaaatcaggaaccatttcccaatgggatatgcatccacatgcctctggatggtggggcaggctccagcaaggagcccctcggctttgaagaggacgacaatcccagcgagatcaagatatccggggagaaatccatggcggggagtttgtag

SEQ ID NO: 955 - DNA, 323 bp, Triticum aestivum
atggtttgtggaggacctccctgccagggcatcagtggattgaacagattcaggaattacaatgagccgctggaagatgatagaaacaaacagttggttgtctttatggatgttgttaactatctgcgacctaaatatgttctgatggaaaacgtcgtagacattctaaaatttgcagatggattcctggggcgatatgcgcttagtcgtcttgtctccatgagataccaagctaggcttggattgatggttgcaggatgttatgggttacctcaatttaggatgcgggcctttctggggggagctcttccttctcgggtttg

SEQ ID NO: 956 - DNA, 2277 bp, Triticum urartu
atgtcaaatcagccggacacgttgctccacggttaccgacctgtgctagacaggcccgaggatgaggaggacatgaaggcgcgcgtccactaccgctccgccatggtcgatggcgtggtctacgcgctgggcgacgacgtctacgtcatggctggggaaaatgaggctgattacattggcagaataactgagttttttgagggtgttgacaagaccagctactttacctgtcgttggtacttccgtccagaggacacggttatatctagagccaaatttgtcaatgatcacacacatgacccaaagcgtgtctttctctccgaggaaaagaatgataatctgcttgattgcatcatatcaaaggtcaagataatccatgttgatcccaatatggacccagcagccaaggccaaactggtggctcgcaccgacttatactatgacatgtcatatacagttgcttattctacatttgctaacatcccatcagacaccacagagaattctggtatttctactgatgctgattcagagaatgggaccccagtaaaaacggcatccctccttgacctgtattctggttgtggtgggatgtcaacagggctgtgcttgggttcagcacttgctggcctgaaacttgaaacagttcgaaatgaaaaagccgaggattttcttgcacttcttaaggaatgggcgattctatgtgacaaatatgtccatagcaatgattctgatgcagcagatcctgttgaggaagaggaagatgatgagcctcttggaaaggatgagtttgtggtggaaaagctacttgagatctgctatggtggcactgggaggaaaaatggaatctattttaaggttcaatggaaaggatatggcccagaagaggatacctgggagcccatagaaaacctgagtgactgcccattgaaaattaaagagtttgtgcaagaagggtacaggcgaaacattctaccccagcctggtcaggttgatgttatttgtggtggcccgccctgccaagggataagtgggttcaaccgatttagaaaccgtgataaccctttagaagatgagaaaaatcaacaaatggttacctatatggacattgtttcttatctgcaaccaaagtttgtcttgatggagaatgtggtggacattctgaaatttgctgatggctatcttggaagatatgcattgagccgtcttgtatccctgaactaccaagcccgccttggaatgatggtagctggttgctacgggcttcctcagttcagaatgcgggtgttcctttggggagctctccctaccatggtcctcccaaagtatcctctccctactcatgatgtagttgtacgtggtggtgctccaaatgctttctcgcaaagcattgttgcatatgatgagacgcaaagaccgactttgaagaaagctctccttcttggtgatgccatttcagatttgcccaaggcaagtgctttcttcccttgtttcatttcttcctcttctacatttgttcttacatccattattatgcaggtagacaactgtcaacctcatgaggtaattgaatatggtggtcaacccaagactgacttccagcgctacattcgacttagtcgtaaagatatgttggactattcctttggtgatgccacttgtcctgaagaaggaaagctcttggaccaccagcctttgaggctaaaccaagatgattatgaccgtgtccagcagattccgataaagaagggggcaaacttccgtgacttgccaggcgtcaaggtcggagcgaataacattgtggagtgggatccagatgttgagcgtgtctacctcaagtccggcaaacctttggtccctgactatgcaatgtccttcatcaagggcagatcaccaaagccgtttggtcggttgtggtgggatgagacagttcccacggtggtgaccagagcagagccccataaccagatcatactgcacccgaatcagggacgtgttttgactgtccgtgagaacgcaaggctgcagggtttccctgactactaccggatgtatggtcccatgaaggagaagtacatccaagtcggtaatgcggtggctgtcccggttgcacgggctctgggctactccttgggccgagcataccagggtgaggtggacgcggggtatgatgcgctgtttgttcttcctgacagcttcaccaacatcggacagaccggtgcgagggcaagggcctcctccgttgggacccctgcaggcgaggttgttgagcagtag

SEQ ID NO: 957 - DNA, 2607 bp, Triticum aestivum
atgggtaaatgtggggataggtgtgtggtgaaagccaatcatttcttcgcggagctccctgataaagaccttcaccaatacgatgtgaccataacgccagaggttacatcgcgaggtgttaatcgtgctgtgattgcagaacttgtaaagctgtatagacaatctcatatgaatggacgtctacctgcctatgatggaaggaagagcctttatacagctgggccattaccatttacttcgaggacatttgaaatcgctctgcaagatgaagatgaaggccttgttggtgggcaagccacgccaaggcgtgagagacaattcagggtggtgatcaaatatgctgcccgtgctgatctccatcatttggctatgtttctagccgggaggcaaccagatgcacctcaagaagctcttcaggtgcttgacattgtgctacgggaattgcctactgccaggtattccccagttagtagatcattttattctcccaacctagggagacgtcagagacttggggacggtttggaaagttggcgtggattttaccagagtataagacctacgcagatggggctttcgctgaatattgatatgtcttctacagcatttatcgagcctctccctgtgattgagtttgttgctcagcttctgtgcagagacatctcagttagaccgcccactgattcagatcgtgtgaagattaaaaaagccctacgaggtgtaaaggttgaggttacacatcgaggaaacatgcgtaggaaataccgtatatctggcctcacatcacaagcaacacgagagctatcattccctgttgatgatcgtggtactgttaagactgtggtgcaatacttcctggagacgtatggtttcaatattcagcacaccactttaccttgcttgcaagtcggtaatcagcaaaggccgaattatctccccgtggaggtttgtaagattgttgaaggacaacgctactcaaaacgactgaatgaaaaacaaataactgctctactgaaagtgacttgccagcgccctcaagagcgtgagaaggacatcttgcagactgtgcatcacaatgcatactatgaagatccatatgcacaggaatttggcataaaaatagatgagcaacttgcatcggctgaagctcgtgttctgcctccgccaaggcttaagtaccatgatagtggcagagagaaggatgtcttacccagggtcggccaatggaacatgatgaacaagaaaatggtcaatggtggtagagtcggccactgggcatgtattaacttctctcggaatgttcaagataatgctgccaaggttttctgtcatgagttggctataatgtgccaaatatctggaatgaactttgcacctgaacctgtgctgcccgtacttagtgcgaggcctgaacacgtggaaagagcactgaaggcacgctatcatgatgccatgaacgcaagcaaacccccgggcaaagaacttgacctgctaattgttatactgccagataataatggttctctttatggggaccttaaaggaatttgtgagactgaacttggattggtatcccagtgttgtcttacaaaacatgtttttaagatgagcaagcagtatcttgcaaatgtagctctcaaaatcaatgttagggtggggggaaggaatactgttcttgtggatgctttggcaaggaggattcgccttgttaccgacagaccgaccataatatttggtgctgatgttacacatcctcaccctggagaagattctagcccttccattgcagctgtggttgcttctcaagactggcctgagataaccaagtacgcaggattagtgagtgcccaagcccataggcaagagctgatacaggatctttttaaagtatggcaagatccccaaagaggaactgttactggcggcatgatcaaggagcttctcatatctttcaagagggcaactggacagaaacctcagagaatcatattttacagggatggtgtcagtgagggacagttctatcaagttctgttgtttgaacttgatgccattcgtaaggcctgtgcatccttggagcccaattatcagcctccagttacctttgtggttgtccagaagcgtcatcacaccaggcttttcgctaacaatcacaatgatcagcgtactgttgatagaagcgggaacatactgcctggcaccgttgttgactcgaagatctgccatccgacagaattcgatttctacttgtgcagccatgctggcattcagggaacaagccggcctgctcattatcatgttctgtgggacgagaacaaatttactgctgatgagttgcaaactctcacaaacaacttgtgctacacatatgctcgatgcacccgctccgtatcaattgttcctcccgcatattatgcacatctggcagccttccgggctcggttctacatggagccggacacctctgacagcgggtccgtggctagcggtgcacgtggtggtcctccacagggcggtccacgcagcagcaccaggttcgggaatgttgctgtcaggcctctccctgccctcaaggaaaacgtcaagcgcgtcatgttttactgctag

SEQ ID NO: 958 - DNA, 3363 bp, Triticum urartu
atggttaggaagaaaagaactggtcctggcagccctggagagagttctggggaagcttccggagcttctgggcagggttcctcgcagcgagcagagagagctcctcaacagcatggtggaggacgtggtttggcacctcaacagcatggccgtggtggggggcaacagcagggccgcggtgggcactatcagggccatggaggatcagcttcacactatccaggtggtggcccacctgaatatcaacagcgtgactatcaggggcggggacatccaggtggtggtccacctgaatatcaacatcgtgactatcaggggcgtggacatccggggggtggcccacctgaatatcaaccacgtgactatcaggggcgtggacatccggggggtggcccaactgaatatcaaccacgtgactatcagggacgtggtggtccgtgccccagaggtggagtgccgcagccatactatggcgggcataggggaggtagtgctggacgtaacgttcctccaggtccatcaagaacagttcccgaactgcaccaagccccgcatgtccaatatcaagccccggtggtttcaccatccgcatcgggagctggctcatcctctcagcctgtgtcagaggtgagcagtggacaagtccagcaacagtttcagaaacttgcgattgttgatcaaagttcaacaagccaatccagtcaactggcaccagcatcaagcaaatcagttagatttccattgcgccctggaaagggtacacatggagataggtgtgtcgtgaaggcaaaccatttctttgctgagctccctgataaagaccttcaccaatatgatgtctccataactccagagattacatcacgtggtgtcaatcgtgctgtgatggcagaacttgttaggctctatagacattctcaattggatggacgcctacctgcgtatgatggaaggaagagcctatatacagctgggccattgccatttccttcaaagacatttgaaattactctgcatgacgaagaagaaagccttgttggtggtcaagtcgcaccaaggcatgagagacaattcagggtggtgatcaaatttgctgctcgtgctgatctccaccatttggctatgtttctagctggaaggcaacccgatgcacctcaagaagctcttcaggtgcttgacattgtgctgcgtgaactgcctactgccaggtattctccagttggccgatcattttattctccaaacttagggagacgtcagaaacttggtgatggtttggaaagctggcgtggattttaccaaagtataagacctacacagatggggctttcgctgaatattgatatgtcttctactgcatttattgagcctcttcctgtgattgattttgttgctcagcttctgagcagagacatctcagttagacccttatctgattcagatcgtgtgaagattaaaaaagccctaagaggtgtaaaggttgaggttacacatcgaggaaacatgcgtaggaaataccgtatatctggactaacttcacaagcaacacgagagctatcattccctgttgatgatcgtggtactgtgaagactgtggtgcaatacttcctggagacttatggttttaatattcagcacaccactctaccttgcttgcaagtgggcaatcagcaaaggcctaattatcttcctatggaggtttgtaagattgttgaaggacaacgttactcgaaacgactgaatgagaaacagataactgctctactgaaagtgacttgccagcgccctcaagagcgtgagaaggacatcttgcagacagtgcatcacaatgcatactatgaagatccatatgcacaggaatttggcataaaaattgatgagcgacttgcatcggttgaagctcgtgttctgcctccgccaagacttaaataccacgatagtggcagagagaaggatgtcttgcccaggatcggccaatggaacatgatgaacaagaaaatggtgaacggtggtagggtcagtcactgggcatgtataaacttctctcggaatgtgcaagatagtgctgccaggggtttttgccatgagcttgctataatgtgccaaatatctggaatggactttgcacctgaacctgtgctgcccccacttactgcgagacctgaacatgtagaaagagcactaaaggcgcgttatcaagatgccatgaatataatcagaccccagggaagagaacttgacctgctaattgtaatactgcctgacaataatggttctctttatggggacctcaaaaggatttgcgagactgatcttggattggtatctcagtgttgtctgacaaaacatgtttttaagatgagcaagcagtatcttgcaaatgtagctctgaagattaatgttaaggtgggtggaaggaatactgtacttgtggatgccttgacaaggaggattccccttgtcagtgacagaccaacaataatatttggtgctgatgttacacaccctcatcctggagaagattccagtccttccattgctgctgtggttgcttcccaagactggcctgaggtcactaagtatgcaggattagttagcgcccaagcccataggcaagagttgatacaggatcttttcaaagtatggcaagatccccaaagaggaactgtgactggtggcatgatcaaggagcttctcatttctttcaagagggcaactggacagaaaccccagagaatcatattttacagtattttcagggatggtgtcagcgagggacagttctatcaagttcttttgtatgaacttgatgccattagaaaggcatgtgcgtccttggagcccaattaccagcctccagttacttttgtagtcgtccagaagcgtcatcacaccaggctttttgctaataaccacaatgatcagcgtactgttgatagaagcggaaacatactgcctggcactgttgttgattcaaagatttgccatccgaccgagttcgatttctacttgtgtagccacgctggcattcagggaacaagccgtcctgctcattatcacgttctatgggacgagaacaaattcactgctgatgagttgcaaactctaacaaacaacttgtgctacacgtatgctaggtgcacccgctctgtatcaattgtgcccccggcatattatgctcatttggcagccttccgggctcggttttacatggaaccggatacctctgacagtgggtccatggcaagcggtgcccgtggccctccacagggtggacgcaataccaggccgtttgggaacgttgctgtcaggcccctccccgccctgaaagaaaacgtgaagcgggtcatgttttactgttaa

SEQ ID NO: 959 - DNA, 2748 bp, Triticum urartu
atgccgtcgcagcctcccactcaacccctcctcacccggacggagcgccgccgccccttctccgcctccggcctgctcgcccgcggcccgtcaggaaccctagcatggccgtgccagaaaattactctactgtgctgtgcccccttgagtattgggagttcgatttgggatccagacttcttcccccacttgattgactctatactacagggcttcttccgtttcaactggatttttttctggtctcaattgaatgaagtctccattaacccggagtcaaaatcaagggctgtgaacagggaggtactcagtgagctaatcaagttgcacggcaagacatcccttgggggcaaattgcctgcctacgatggaagaaagagtctttacactgcaggctcactcccttttgagtctgaggagttttctgttacactggttgatcccgaaaagaaagacaaagaaaaggctgaaagggagtacaagatcaccattcggattgctgggaggacagacctgtaccacctccagcagttcctcaaaggaagacagagggatatgcctcaagaaaccatccaagttcttgatgttgtcctcagggagtcaccatcctggaactatgtcacagtgtccagatccttcttctccaccacctttggtcacagaggagacattggtgaaggattagagtgctggagaggttactaccagagcttacgtccaacccagatggggctgtcactcaatatagacatatctgcgacatccttcttcaagcctgtgacagtggtccagtttgtgctagagttcctcaacttacgtgatgcctcgcggcctctgacagacagggaccgtgttaagataaagaaagcactccgtggggtgcgtgtcgaaacaaaccaccaggaagaccaaatccgaagatacaagataacagggattactcctgttcccatgagccagctcatatttcctgttgatgagagaggaacaagaatgtcagttgttcagtacttcatgcaaagatacaaatacaatctgcagtatacttcttggccctgcttgcagtctggaagtgatgctcggcctgtgtatctgcctatggaggcgtgcaagattgttgaagggcaaaggtactctaagaaattgaatgacaagcaggtcaccaacatacttagagctacctgtcaacgtccccagcagagggagcaaagcattcgtgagatggttctgcacaacaagtatgctgaggacaagtttgctcaggagttcgggatcaatgtctgcagtgaccttgtctctgttccagcccgtgtgctgcctccccccatgttgagatatcatgattctggaaaggagaaaacttgtgcgccaagtgttggacagtggaacatgattaacaagaaaatgatcaatggaggaatcatagacaactgggcctgtgtgagtttttcacgcatgcgtcctgaggaggtatacaggttctgttgtgatctgattcagatgtgcaatatgactggaatgtctgtcaatccaaggccacttgtagacaaccgatcagctagccccaaccacatcgagaatgccttgagggatgtatacaggaggaccaccgaaatgcttggaaaacagggaagcgaaaaacagctacaactgttaattgtaatcctacctgaagtcagtggttcttatgggaaaatcaagaaggtttgtgagactgaccttgggatcgtgtctcagtgttgcctgccaaggcatgcttccagaccgaacaagcaatatttggagaatgttgcactcaaaatcaatgtgaaggtcggaggacgcaacacagttctggagagagcttttgtgcgaaatggcataccgtttgtgtccgaagtcccaacaatcatctttggtgctgatgttacacaccccccacctggagaggactctgcatcatcaattgctgcggtggtggcatcaatggactggccagagatcaccaagtacagaggtcttgtctctgcccaaccacacaggcaggagataatcgaagacctcttcagtgtcaccaaagatccgcagaggggtaatgtcaatggtggcatgatcagggagttgctgattgccttccgcaggaagacaggccttaggcctgagaggatactcttctacagggatggcgtaagtgaaggccaattcagccatgttctgcttcatgaaatggacgcaatcaggaaggcctgcgcctcgttagaggaggggtatatgcccccagtcacctttgtggttgtccagaaaaggcatcacaccaggctattccctgaggttcatgggaggcgtgatatgaccgacaagagtgggaacatacttccaggaactgtggttgacctcatgatttgccaccctacggagtttgatttctacttgtgcagccatgctggcattcagggaactagcaggccaacacactaccatgttctttatgatgagaatcacttcacagccgatgcgcttcagtcactgaccaacaatctctgctacacctatgctcgttgcactcgtgcggtctctgttgtcccaccggcctactacgcccatcttgccgcattccgtgcgcgctactacgtggaaggggacagctcggacggcggatcgacccccggaagcagcggtcaggcggcgattgcgcgtgagggccctgtggaggtgcgccagctcccaaagatcaaggacaacgtcaaggacgtcatgttctactgctga

SEQ ID NO: 960 - DNA, 2751 bp, Triticum aestivum
atggagtcacacagtgatgacttgccaccaccaccaccactcccgccaaatgcagagccgataaaagctgagtcggctgatgacttgccaccaccaccacccctgccgcctatcaaacctgaagaagcaaagaagatctcaaagcctaagagggccctgatcgctcgtcctggttttggcaagaggggaaatcctatacagcttgtgacaaatcatttcaaagtctcgttgaagacgacagatgaattcttccatcattactatgtaaatctgaagtatgaagatgacaggcctgttgatggaaaaggtgttggtagaaaagtcattgataagcttgctcagacttatccatcggagctagcccataaagactttgcctatgatggtgaaaagagtctttttaccattggtgccctcccacaaattaacaatgagtttgttgtggttcttgaagacgtttccagtggaaagactcctgcaaatggcagccctggaaacgacagtccagacaagaagagagtgaaaaggccatatcagactaaaaccttcaaggtggagctgagttttgcagctagaatccccatgagtgctattgcaatggcactcaaaggccaggaatcagagcacacgcaagaagccgttcgggttattgatatcatattaagacaacactcttccaaacagggctgcctgttagtccgccagtcactttttcacaacaatccttcaaactttgtggacttgggtgggggtgtgatgggctgccgaggtttccactcaagctttcgagccacacagagcgggctttctcttaatattgatgtttctacaacaatgattgtgaaacctggccctgttgttgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacagatgttttccctcaagcaaaggaatggtgggaatggtgaccctgaagcaatagaaatatctgtttatgattactttgtgaagaaccgtggcattgagctgaggtactctggtgatttcccttgtataaatgttgggaaacctaggcggccaacatatttccccattgagctctgccagctggtgcctttgcaaaggtataccaaatctttgagtaccctacaaagaccatctcttgttgagaagtccaggcagaagcctcaagagaggatgtcagttttgtctgatgtactgaaacgcagcagctatgatacagaacccatgctgaaggcatgtggaatttcgatagctcagggctttacacaggtggctggtagggtactgcaggcccccaagctcaaagctggaaatggtgaagatattttcacaaggaatggacgttggaatttcaacaacaagaggcttgctagagcttgtgtggtggacagatgggcagttgtaaacttttcggctaggtgtaacaccatgaaccttgtcaatgacctcatcaagtgtgggggcatgaagggcaatacagtagaaaaacctcatattgtaattgaagagaatggttcaatgagacgtgcacctgctccaaaaagggttgaggatatgtttgagcaagtgaagtctaagcttcctggggctccgaagtttctcttgtgtattcttgctgagaggaagaactcagatgtttatggtccatggaagcgaaaatgccttgctgactttgggtttgtcactcaatgtgtggccccaacaagggtcaatgaccaatatctgacaaatgttctgctgaagatcaatgcaaaacttggtggaatgaactcactacaacaaattgaaatgtccccaagtatacctcttgtatcaaaggtcccaactctcatcttgggaatggatgtgtcccatggatcccctggacagtctgatataccgtccattgcagcagttgttggttctcgggaatggcctcttgtctcgaaatatagggcttcagtgcgctcgcagtcaccaaagctcgaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgctgattgttgcccagaaaaatcaccacaccaaattcttcatacctggatctcctgacaatgtccctccaggcactgttgtagataatgcagtctgccatccaaggaattatgacttctacatgtgcgctcatgctggaatgattgggactacaaggccaacacactaccatatcctgcatgatgagatacactttgctgcggatgacctgcaggatcttgtgcactcgctctcatatgtgtaccaaaggagcacgacagccatatcagttgtttctccaatctgctatgcacatcttgcggctgctcaggtggcgcagttcataaagtttgatgagatgtctgagacgtcgtcgagccagggcggtggccacacctctgccggcagcgctccagtgcaggagctgcctcgtccccatgagaaagtccgcagcagcatgttcttctgctga

SEQ ID NO: 961 - DNA, 2340 bp, Triticum urartu
atgatcgtgcgagcgaaccacttcctcgtcggcttcgcggacaaggacatctgccactacgatgttgcaattactcctgagcccaagacaagacggatcaacagggttctaatgacggagctgacaagcaagcaccgcgtgtcgtctctcggtggcctactggtcgcatacgatggcagcaagagcctgtacactgcaggcgagctgccattccaggcgatggatttctccatcaagctggggaaaccaccaagagaaacctatgtcaccgtttctcgatccttctactccacaatatttggccaacgtgacatcggtgatgggctggagtgctggagaggatattaccaaagcttgcgccccactcagatgggcctctcactgaatatagatatatcatcaacgccattttacaaacctatatcggtgatgcaatttgttcaggagtgtctgaatctgaggaatcccgaccccaatcgccccctttctgacagggaccgtctgaagcttaggaaagcattgcgcgggattcgtgttgaaaccactcatcaagagggcaaaaggagtgcctacaagataactgggattacttctgttccgctgattcagctcaactttcctctggatgaaggcaaccaaatgactgttgtgcaatacttttggggccgatacaagtatagattgaggttcacttcttggccttgtctgcagtctggaaatgattctcgccctatatatttgccaatggaggtatgcaaaattattgaagggcagaggttcaccaggaagcttaacgagaaacaagtgactggcatactgagagctacgtgcgaacgcccccgtgatagggagaacagcatacttaagatggtggagcacaacaactattcagctgataagctggcgcaggagtttggaattgatgttacagataaaatgctcaaatatcatgaatctggaaaggacaaagcttgtgcaccaagtgttggccagtggaacatgattggcaagaaaatgataaatggagggaatgttcagagatggacttgcttgaacttttcacgtttgcacattgatggagtcaaaaggttttgtggcgacttagtcaaaatgtgcaacgccatcgggatggttttcaatcctatgccagtggtagaaattctctcagcgtccgccaataacatagaaggtgctttgaaggatgctcaccagagtgcccgtgacctccagttgcttattgtgattcttccggatgttactggccattacgggaaagttaagaaggtgtgcgagactgaccttggtatagtatctcaatgtctcaagccagacaaggtcgaaagagcaaacaagcagtattttgaaaatgttgcacttaaagtcaatgtcaaggtcggagggagaaatacagctcttcagcaagctcttacacgtcaaataccgttagtcaccgatcaaccgacgatcttttttggtgctgatgtaacacatccggcggcaggggatgattcctcaccgtcaattgcagccgtggtggcctccatggactggcctgaaatcacaaagtacaaagctgtggtttctgcccaaccgcccaggcaggagattattcaagatctctattgcacaggcatagaccctgagaagggcacccctgtacacagtggaatgatgcgggagttgctagtgtcattctttcagaagaccaaacataaacccagcaggatcatattctacagggacggtgtgagtgaagggcagttcgcccaagttctgatgtatgaaatggatgccatcaggaaggcttgtgcatctttgcaggaggattatcagccccctgtgacatttgtggttgtccagaaaaggcatcacacaaggctcttccctgaggtgcacggaaaagagaccgacaaaagtggaaacatccttcctggaaccgtggtcgacaccaacatatgccatcccaccgagtttgatttctacctgtgtagccatgccgggattcagggcacaagcagaccaactcactaccatgtcctcttcgatgaaaaccgtttcactgccgatgggctgcagctgctcaccaacaacctgtgctacacatacgctcgatgtactcgctctgtctctgttgttcctcctgcctactacgctcacctggctgcgttccgcgcacggtattacgacgagccatcggagggctcggacagcgcctcgatcgtcagcggtggcacccgggagtcagctgccaccggcgcaggagctgctggtcctcctgggacataccgtcgcctccccaggatcagggataacgtcaaggacgtgatgttctattgttga

SEQ ID NO: 962 - DNA, 2445 bp, Triticum aestivum
atgtcgggaaccgcggccccacggtacgcgccggacgaccctacggtgccgaagccgtggcgcgggctggtggacggcaccaccggctacctctactactggaatccggataccaacgtcacccagtacgagaagcccgtgccgccggaagctcagctcccgccgcccccgcctctcccgcctcctcctccgcgcgcccgcggccgggaccgtcgagaccgttcccgttctcgctcccgctcccgttctcgcacaccgcctcggcgtgaacaccgggaccgcgaccgcgaccgcgacaggcgccgtcacgacgagcacgactcgttcaagccgtcgtcgtcccatcaccatcttcctccggctgccaccatcatccctaccgccgcagctgatgatccatcagccgaagcataccgccgtcgccatgagatcacagtcatcggggataacgtgccggctcccataactgagtttgactctggtgtcatcccgcttgatatactcaaggagatacaacgcgccggattcccaagtccaacgcctatccaagcccagtcctggccaattgccttgctcaatcaagatgttgtagctattgccaagacaggatctggaaaaactctcgggtatttgcttcctggctttatgcatataaagcgtatgcagaacagcacaaggtctggcccaacagtgttagttttggcacctaccagagagctcgcaacacagattttggaagaagctgtgaaatttggcagatcatcaagaatttcttctacgtgcctttatggcggtgctcctaaagggccccagttaagagatttagaaagaggggttgatgttgttgttgcaacacctggaaggttgaatgacattctagaaatgcggaaaataagcctaaagcaggtctcgtaccttgttctagacgaggctgaccgcatgctagatatggggtttgaaccacaaatacgaaaaatagtaagagacataccttctggtcggcaaactcttatgtacactgctacttggcccaaggaagtccgaagaattgcagatgagcttcttgttcaccctgttcaggtgaccattggaagtgtggatgagcttgttgctaataaagctattactcagcatgtggaggtggtcactccctcagaaaagctttggcgtctggagcaaatattgcgatcccatgattcaggttccaagatactaatattctgtaccaccaagagaatgtgcgaccaactatcaaggacactcaataggcaatttggagcggctgccattcatggtgacaagtctcaaaatgaaagagagaaggtcctgagtcaatttagatctggacgatctcctattttggtggctacagatgttgcggcacgaggtttagacatcaaagatatcagggttgtgatcaactatgacttccccactggtgttgaggactatgttcacaggattggcaggacaggaagggctggtgccactggtttggcctatacgtttttgtgtgatcaggattcaaaatatgccgccgacctaattaaaatcctggaaggggcagaccaagatgttcctcctgaactgttagacatggtctctcggggtgggcgtggtaggaaacgtaacaaatgggcaacccgctctgagaggggtggtggttcacgccctgaactggattcaaggtatggtggcaggttagagggtagtcgcggtggacgtggaaaggatgattatggtggccgtagcaggaatgatcacggcgggtctcgcaggtctgctagaggtcgcagcagaagccttagcaggagtgacagtgataggcgcagcccaagccccaagagacggcgccatgatgtgcagtctagccgtagcaggactagaagtcggagtcggagcaggagcaggagcaggagcaggagcagaaacaagagcaggaataggagccggagcaggagttacactaggaatcgtcgtgctagccgcagcaggagtcgtagccctggcgctagacgcaggcctgaaagaagagctggctctgggtctacacgtcctgactctgcccacccagtggagaagaaaagctcacccaatgctcacccttcaaatgaccacaggagccgcagtgtcgacccttcaaatgactatcaggcggaggatgggaagatgggaaaggttgatctggatcggtcgcccagtccgcaggagcaggatgacaagtctgctccatatagttctgtgtataatggcgaaggaggcagggggtcaatgagccctaatggcgagccagtggtggatgctaaacctgtggaagtctctgtgagcagcaagaagagggaggatgaagaggaaggtatgattgatgaagagggagaggagggtatgatagccgatgatgaccctcgcgcaagtgcagctgtgcaaaacggtggtgataagtga

SEQ ID NO: 963 - DNA, 4539 bp, Triticum urartu
atggcgagcgagccggaagaaggtctacactttctgcagagcaaaatggtcccagttaatgtttgccaagatctaggcctatactggagcgacaaagaatggggtaggctgctgcccatgacatgcttgtcggctttgccagccacaagtcggatggacagccaattggtcgagctctgcatcagccgctgtggtgaatggttggtctctagtgttgcctactccctgcaatgcgggtctaacaagcttaattacaccaaatgtatcaacagccttgaagaattattgcatgccaaggtctgttcggttgataatgcagagctggaaagtgtgcttgcttttcctgatatggaggtgtacacttacgtcccgcttagtcactctaatcttactgtaacttacaacaaagaacttgatcgctcaaagcttgagagtgaacgcatactacgcgagagcctatacgatttcaaggattctcagaagaaactaaagtccctggggaggttgcatggaaatttagtattctgtttgcaagaacttggttcgtttggagctctgcaagctgcaaaggctttcctttcatctgatggtgatgttttggacagaaaggagtctgacatgaacgacaattctaccagatttaagcatcattacctaaacaaagcaatttctgttctgaattgcaacatattagacgcccttcacgaatctgacaagacgtgctttctaggtacccatgatgattcatttcatctagagatgctagaagaacctttcttctcaaataaaattgtggttcttattaaaattctctcgagatacaggctagaggaaaacatgaagtgcatagttttcgtgaaaagaataactgttgcaagagcaatagcacatatcctccaaaatttgaaaggccttgatctttggaaatgtgagttccttgtgggacgccactcgggaccaaagaacatgtcaaggcagaagatggatgctattgttgaaaatttctcttctggcgaggtgaatcttttgattgctaccagtgtaggtgaagagggtctggacattcagacttgttgcctcgttgtgcggtttgatcttccagaaactgttgccagttttatccagtcgaggggacgtgctcggatgacaaattctaaatatgttgttctcctggagaggggcaatcattctcaagaaaagttgcttaatgactatattgatggtgaaggcattatgaatggagagatagacttgagaacttcaaatgatgtgtttgatcacctcgaggagaaaagttatcgagtggaaaaaacgggtgcttccattagcactgcatgtagtgtatctctactgcatcgctactgctacaaccttcccaaggacatgttcttcaatccttccccagcattcatctacattgatgacactgaggggataatctgcagagtaattcttccaccaaatgctgcttttcgtcaagtggatggccaaccatgccaatcaaatgacgaggctaagagggatgcatgcttagaggcatacgtgaaattgtatgaattgggtgctttgacagattttcttctgcctggttcaggttcaggaaagaacagggcatcaacaacaaacggttcagcaagcaacagtcatgatgatgaaagtctaagagaagagcttcatgagatgttaattcccacaattctcaaaccttcaacatgcaaactggactgtccattgaacttgcatttctactatattcaattctttcccataccagcagatagacattatcggatatttggtctttttgtgatcaactcccttcctatggaagctgaaaagttggaggttgatttgcatctggctcgcggcaggattgtgaaagcaggaaagaaacaatttggggcgatgatgctggcacgcaatttccaagaaatgtttctgaaggttctcctggacagatctgagttcactgtatctcatgttatgttgttgggcaacagtgaaacgctacagtttaattcaaccttttacctgctgcttccaatcaagcaggaattgtatggtgatatatttatgattgactggcaaacagttaagcgctgtttatcatcaccggtttttaaagatccaactggtgtgtctgcgcatggatcatatttgccagatgagtctttaaggcttcttgataatatgtacagtaaaactgatgtcgttggcagtctaatctttgctccccatattaagacatttttcgtcattgatgtcattctgaatgaactaaatgctagaagtgaatacgacggtgctacttatgaagatcattacaaggaaaggtttggtatcaaactatcacatcccgagcagccacttctgcacgctaagcagctctgcaatctgcataatttgcttcatgaccgattacgggagaccacagaagaaggtcgtgaattgatggagcactttgtggagttgcctccagagctatgttctttgaagataattgggttttcgaaggatatgtgtagctccctgtctttgttaccatcgttgatgtgtcggttggagaatttgctggtagctattgagttgaaggatgtcatgttgtcttcattctcagaggcttctcaaattagtgcctctggtatccttgaagcacttaccaccgaaaggtgtttggagaggatttctttggagcgctttgaagtcttaggtgatgcttttttgaagtatgtagttggacgtcacaactttcttacatatgaaggacttgatgaagggcaattgaccagcagacgttctgctatagtgaataattcacatttatatgagttatcaatcaaaagaaatttgcaggtgtacatacgggatcaacactttgaaccgacacagttcattgcactgggaaggccttgtaaagttgtttgcaatgctgacacagaagtgaatatacacacagatagtcgagaaaactgtaacttgaggtgtacaaagtcgcatcattggttgcataggaagactatagcggatgctgttgaatcgcttgtcggagcatttcttgttgaaggtggattcaaagctgcatttgcattccttcactgggtgggaatagatgttgattttaaagattcatccctatatagagtattagatgcaagctccatcaatttatctctcacgaaccacaccgacgtcggtgagcttgaggaattaatcggttacaatttcaaacacaagggtctaattctcgaagcatttgtgcatccttcattcaataaacattctggaggatgctaccagaaattggagttccttggagatgctgttttggaatatttgataacctcgtacctctactcagcttatcctgatctaaagcctggtcaaataaccgatttaaaatcgttagctgtcagtaataattcgcttgcatatgtggcagtccagaaaggtatccataagtatcttataaaggattcaaattatctttcgtcagcagtgaataagtttgagaattatattagacttcccaattcagagaaagacttggtagaagaaccagcatgcccaaaggttcttggtgatattgtcgaatcttgtgttgctgcagttcttttagattcaggattcaacctgaactacgtttggacgctagtgcttatgcttctaaagccagtgttgagcttctctgacatgcacatgaatcccatgagagaaattcgggaactttgtcaatctcatgaacttgagttaggccttcccgaacctatgaaagccgatggagagtaccacgtcaaagtggaagttaacataaacagccaggtgataagttctgccgctgcaaaccggaattcaaaagttgctaggaagtttgctgcacaagaaacactttctaaactgaagaattatggatacacacataaaaacaagtcactggaagagattttgcgagatgctaggaagaaagaaccagaactactaggttataatgaagaaccaatcaaagtcgaggctgacatatctgcagaaacaaataatctgaagataggtaaagaaagggatgcaaacatctctttccaaaatacagcaatttctattcgtgggactcttagaacctctagccaaagaacagcagggaataccatgttttccaaggatgatgtcagtattgaaaggaataatcagctcaaggttgcaaagcagaatgcctgtctgccgaagggaacaactcagaaaaatattagaaaggagtatcatggtgatatggtaaataaaacagcaaagtctttcctttttgaagtatgtgccgtaagttattggataccccctgaatttgaattgtgcaaagaagaagggccaagccacctccgaagattcacgtacaaggttacagttcagatcaggggaccctcggagacactcttggagtgctacagcgatgctcaactacagaagaaggccgcacaagagcatgccgcgcagggggctctgtggtatctcaggcaacatgggtacctacccaaagatgaagttcgtgtgtag

SEQ ID NO: 964 - DNA, 2844 bp, Triticum urartu
atgggtggcaagactcttcaggtgtcaggatttcctgcaactgtcaatgcagaccatgtcaaggatttgctggaacgaattgttggtgtggataacgtctgtgtggttaagctcaggcctccgaagaacaactctgcaaactcaagatcttttgccattgttcagttccagaccgaggcacatgcttcgctggtggtgaatgcggctcgtgggaatgcacttaggagtggaagcaattatctgaagaaatacagacttgaactttcatatgagagcatatgggagatccagcttcatgatccacctggatcacaaaaaaagttccttttgattcaggttctggctgctccaaaaatttacgaacaaaacttacagcattctggctctatgtacgacgatccattattcaactattttagggatgatactgatgatcagtggaccagaactactgattttactccattagccagcattgggcaatcatatattctgtgtctggagctaccacatgattgtgatctccccaacattcaagagtactttgtttactataaagaacacaagcgtgactttcattgccatcgtggacattcatattcaagcaatacttgctttgctccaattgtgaaatctctttatttcactgatatcccctatgagatactcttcaagatcaaccacatggttcagaatgggacacttagtgggccgacacttgatgacaacttctaccgtctggactgtgagaagcttcgttcgactgatttatcaccacgttctgctcccggaaataatgcaaggagaactgctctgtacaacagaattctgtcggtcctttcaaatggcatcactattggtaacaagcactttgagtttttggctttctcttcaagccagctgcgggataactctgcgtggatgtttgcttctcgtccggggttgtccgccagtgacatcagggagtggatggggaacttccgtaatattagaaatgtggcaaaatatgctgcaaggcttggtcagtcctttagcgcctcaacagaaaccttgaaagtacataagtatgaggtgcatgtaattccagatataaaaaatggtacgaagtatgtattctctgatggaattggaaccatttcagctgattttgcagacgaggtgtctaagaagtgcaaattggcccgctttactccctctgctttccaaataaggtatgggggttacaaaggtgttgtcgctattgatccaacatcacactggaaactttctttaagaggaagcatgtcaaagtttccgtcagacaacatcacactggatgtccttgcatacagcaagtaccagccatgtttcctgaatcggcagttaatcactcttctttcaactcttggagttagagataacatatttgaactgaagcaacaagaagttgtgaagcagttaaacagaatggttactgaaccacaagctgctattgatgcaattgaacttatgcccatgggagagattaccaatgttgttaaagaattgctgttatgtggctacaagccggatgttgaaccatatctttctatgattctacaaacctttagagcatccaagttgctagaactgaaaacgaagtcaaggatattcatcccagaaggacgagcaatgatgggatgcttggatgaaacccacacactgaagtacggagaggtattcattcaagcttctaatagtgcaaatgacagtgacaagttcgtcgtaactggaaaagttgtcgttgccaaaaacccttgcctccaccctggtgatatccgtattctcgaggctgtttatacccctgttctggaccatatggttaactgtgttgtctttccgcagcaggggccaaggcaacaaaatctcatttctgtaaatatgttcttatttggtactagaaatcaacagtggaagataaaacaggaagtacatgagtatttcgcaaattacatagttaatgagagtctgggaatcattgccaacgcgcacgtggtctttgcggatagggaaagcttgaaggctgaaagtacaccatgcattaagctggcagagctcttctccgttgctgttgattacccaaagactggagtgccggctcaaattccgggcgaactacatgtgagggagtatccagattttatggagaagctcgacagggtcacctacgtatctgagggagtaatagggaagctgtatagggagattaagaagcagagccctcacatagggcatttcacaaaggatgtggcaaggcggtcttatgacagtgatttgattgttgatggctaccaagactacatcgacgaagctgtgtggatgaagggagagtatgacttcaagttgggtaatctgatggagcactatggaataaaaagcgaggctgagataataagtggatgtattcttaagatggcgaagaattttaccaagagtagtgacgccgatgctattagacaggcggtgaaatcattgcggaaggaagcaaggtcatggttcagcgagatgaacgccagtgagagcggggatgttcctgaagccttgtatgccaaggcatccgcttggtatcatgttacctatcaccccgagtactggggttgttacaatgaagtatatggtcggccacacctcatcagctttccatgtgcttggtgcattgaaatgaatggaggatccaaatttagagattgtgagactgctgataactggtggtccggttcagaagagaaaagtactgaaaccacaaatagcgattcaactgatatggtctcgggtgtacttaacatgcttcagaaggtggtctcgttgagaaatgcaatgccatga

SEQ ID NO: 965 - DNA, 510 bp, Triticum aestivum
atggcctccaaccagaaccaggcgagctacgcggccggcgagaccaaggcccgcactgaggagaagaccgggcagatgatggacaaggcggggcaggccacggaggccaccaagcagaaggccggagaggccaaggacaagacggcccagacggcgcaggcggccaaggaccgcgccgccgagagcaaggaccagaccggcagcttcctcggcgagaagacggaggcggccaagcagaagaccgccgaggcaaccgatgcggccaagcagaaggcgtcggagacggcccagtacgcgcaggagaggtcctccgacgcggcgcagtacaccaaggagtccgccgtggccggcaaggacaagaccggcagcgtgctccagcaggccggcgagacggtggtgagcgccgtggtgggcgccaaggacgccgtggcgaacacgctgggcatgggcggcgacaacaccaacaccgccaaggacagcaccaccgagaagatcactagggatcactag

SEQ ID NO: 966 - DNA, 7949 bp, Triticum urartu
ctttcataagtggtttccatgaagttttctttgaaacttggcttccatgtgatattctctccaacccattttggggcatctagtactccctctgtaaactaatataagagcatttagataactaaagtagtgatctaaacgctcttatagtagtttacagagggagtaattaccaatgaaatatcacctttgtcccaaattacttgtcttagatttgtctagatatggatgtatctagacacgtttagtgttggatacacctgtatctagacaaatctaagacaagtaatttgggacggagggagtataataaagcaataaagaggtataattcatctatgaggtatatgagaagcggatcatactacccggagtttagaatgatttttgtatgcatatatatgtgtgcttttgcgtgcgtgtgtgtattacgtgcctactctatagattaatatagctcactattttctcattttgctatggcaaaataagtattatatcaaaacaacaacatctagcatagattatgcgatagccagctacagctgcaatatttccaattgaatattcctacccctgaatgccatggaccacattttaaaaccttatttattgtgattgttaatttacaatctgaatctgtttaacatttgtcagcagtttttttttactatgttatggccgcatgttaacctagccttcttgttttcattgatataagcgtagttttacttcctattaatatagttcatatttttattgtttgtgccctgtcaaccttatgttaggataacttgatcagttagcaatagtcttatgcaattttttacagcttatcttctactccctctgtcccaaaaataagtgtcttgagacacttattttgggacggagggagtatttctgtaatattatgttgcacgatttcctttatgccctttgtgccttgctttggccctacaagcatcagttatgccaacttttaaccgaaaattttattgctgtcttctttacaaattatagtaatgtgtacccaaaccctattgtgcatcacccattccatttctttttctttttaagacttgactaataccatgtcttggttgataagctgctcctgtttgtgaggtagaagtatatgcgataagaggatacagtcaaattgtaggtgttggattacatgtttagactatgtgatgtcgtatatgcacttcctagagtgtaaattgagaaatgcacccattccgtttctcttgttaggtttatgcttgattctaatattccatcattctacatgaagttatacttgatactccctccgtccgaaaaaacttgtccaaagcttgtctctcaaatggatgtatctagcactaaattgatgctagatacattcatttgagggacaagctttttcgcacggagggattatgtattagtcttgatactttacattctcatgatcttacattttggtgctctcttgtcttagcagcggccatcatggttaggaagaaaagaactggtcctggcagccctggagagagttctggggaagcttccggagcttctgggcagggttcctcgcagcgagcagagagagctcctcaacagcatggtggaggacgtggtttggcacctcaacagcatggccgtggtggggggcaacagcagggccgcggtgggcactatcagggccatggaggatcagcttcacactatccaggtggtggcccacctgaatatcaacagcgtgactatcaggggcggggacatccaggtggtggtccacctgaatatcaacatcgtgactatcaggggcgtggacatccggggggtggcccacctgaatatcaaccacgtgactatcaggggcgtggacatccggggggtggcccaactgaatatcaaccacgtgactatcagggacgtggtggtccgtgccccagaggtggagtgccgcagccatactatggcgggcataggggaggtagtgctggacgtaacgttcctccaggtccatcaagaacagttcccgaactgcaccaagccccgcatgtccaatatcaagccccggtggtttcaccatccgcatcgggagctggctcatcctctcagcctgtgtcagaggtgagcagtggacaagtccagcaacagtttcagaaacttgcgattgttgatcaaagttcaacaagccaatccagtcaactggcaccagcatcaagcaaatcagttagatttccattgcgccctggaaagggtacacatggagataggtgtgtcgtgaaggcaaaccatttctttgctgagctccctgataaagaccttcaccaatatgatgtatgccctttacatgaagttctttttccccactgcagtttttattttgtaatttttgatcgacaatcttgttttgtcaggtctccataactccagagattacatcacgtggtgtcaatcgtgctgtgatggcagaacttgttaggctctatagacattctcaattggatggacgcctacctgcgtatgatggaaggaagagcctatatacagctgggccattgccatttccttcaaagacatttgaaattactctgcatgacgaagaagaaagccttgttggtggtcaagtcgcaccaaggtatgctgttgctgtgacatttgtacttcattgtgttcatagtagttctgtactgacattccttttgttttaaggcatgagagacaattcagggtggtgatcaaatttgctgctcgtgctgatctccaccatttggctatgtttctagctggaaggcaacccgatgcacctcaagaagctcttcaggtgcttgacattgtgctgcgtgaactgcctactgccaggtatcctttagcaaaccatgtcttgttttattgtttttctggctgtatgggttataatttccatgtgtttttcttctgtaggtattctccagttggccgatcattttattctccaaacttagggagacgtcagaaacttggtgatggtttggaaagctggcgtggattttaccaaagtataagacctacacagatggggctttcgctgaatattggttagatatccctctcatgtttttttttacctctgtgtcactgttcatttgttgttttgttagttgtgatgaacggtgggtggcccaaagtaatactcccgccgtcccaaaataagtgtcgctgatttagtataaagttagtacaaagttgtactaaatcaacgacacttattttgggacggagggagtacataacgttccactttacagagcatcttagtggaggttacatattgggagtggtcttgctgacataatgatttatatgatgtttattcttgcagatatgtcttctactgcatttattgagcctcttcctgtgattgattttgttgctcagcttctgagcagagacatctcagttagacccttatctgattcagatcgtgtgaaggtttgattcaccacttgtttcactgtttttaacggacttgctttatgcagagttaccataattacccccccccccctcctgcagattaaaaaagccctaagaggtgtaaaggttgaggttacacatcgaggaaacatgcgtaggaaataccgtatatctggactaacttcacaagcaacacgagagctatcgtatgtgcttcttccctcgctttatacaccgaaatctttatgctcttgtacgttcgtgggtgatttgatttcctgttggtttcatgtggtagattccctgttgatgatcgtggtactgtgaagactgtggtgcaatacttcctggagacttatggttttaatattcagcacaccactctaccttgcttgcaagtgggcaatcagcaaaggcctaattatcttcctatggaggttactatcttgaacaatcttgcttgcattgatttgaaaatgatatgctcatctatgtgctacatccagtctcagcatcttgtcgagttgttcaatgagtttatcactctgaaatatcaggtttgtaagattgttgaaggacaacgttactcgaaacgactgaatgagaaacagataactgctctactgaaagtgacttgccagcgccctcaagagcgtgagaaggacatcttgcaggtgattgttcattatattatttctgatgcaagctgttataactgctgttacaaaattgccttatgacatgctgtgcctatcacttgctattttttgtgcggtgctgcttggcgttctcctcagtttgacaaaaaatttccacttcgatgtattcaatccacactattgcaatcaaataatctataaagttataaagttcttggaattcctccacaagcatgttttacaagatgatagttgtttgatgagatttttgttaaggccaaaaccataatttttgggaagacaactatctatgaggctatgacctatgagccatttatctgaactgttcttttgtctgtattattcatacacactagtacactacccaccgattcactctaatctgcaccagctttatacatttaaactggactatctaaatctcttctctcgcttttcatatttgaccagacagtgcatcacaatgcatactatgaagatccatatgcacaggaatttggcataaaaattgatgagcgacttgcatcggttgaagctcgtgttctgcctccgccaagagtaagtctattcagacttgattagacagcagttgacttaccatattggacatacgttgtgcgtagcaactgactacaccttttttattagcttaaataccacgatagtggcagagagaaggatgtcttgcccaggatcggccaatggaacatgatgaacaaggtacaccttgataaaatgtcaccagaaattaaaatattactcccaccgtcccaagattcttgttatagatttttttagatacggatgtatctagtcacgttttagtgttagatacatccgcatctagacaaatctaagacaagaattttgggacggaggtaatatcatttttgtaaaggccttcagctacctgtttccataccgggaacagtagtggagaatcgtactgcaagaaatttggaacaaaattatgctagatagataaaataacatacagtacctagattgtctgcttctttgcaacacacaactttgctaaatactacactaaggagttttattgatgctatttaacttcatattcttgcgttcatttcttcacatttcctgaagaccgtctagtttcacatgtgaacattttaagagtctgcatgatttaccttaaccaaccatatactattttggttggtatctctctgatgttagcatttcttaaacctagacctacatctactttctactccctccgttcctaaatacttgtctttctaggcatttcaacaagtgactacatacggagcaaaatgagtgaatctacgttctaaaatatgtctacatacatctgtatgtagtagtcatttgaaatgtctagaaagacaaatatttaggaacggagggagtaggtactagtggctgtagttttactgcatatccccccttttgtcttgttagtcttgttatgttttatgtagttctgatatgtgttcattttcattggtagaaaatggtgaacggtggtagggtcagtcactgggcatgtataaacttctctcggaatgtgcaagatagtgctgccaggggtttttgccatgagcttgctataatgtgccaaatatctggaatggtatgatcgagtcatcaaactagctttccataatatatctgttcacttctcttatgttgtattctctggtgttaaaattcttactttctctctctttcttaggactttgcacctgaacctgtgctgcccccacttactgcgagacctgaacatgtagaaagagcactaaaggcgcgttatcaagatgccatgaatataatcagaccccagggaagagaacttgacctgctaattgtaatactgcctgacaataatggttctctttatggtatgatctcttccaaacaacatttaaagattgcctggatgatatttttgcttattatctttctttccctcccaggggacctcaaaaggatttgcgagactgatcttggattggtatctcagtgttgtctgacaaaacatgtttttaagatgagcaagcagtatcttgcaaatgtagctctgaagattaatgttaaggtatttcgctgtgcttcaaccattccatctttattgtgcacctcggttgttatatgtttacctactttttaggtgggtggaaggaatactgtacttgtggatgccttgacaaggaggattccccttgtcagtgacagaccaacaataatatttggtgctgatgttacacaccctcatcctggagaagattccagtccttccattgctgctgtaagtgacttattgctactatgaatttttttgaagttctgctatgatacaatggacctgctaggtgtactggaagctaatcgcgtgcaatattctttccttcaggtggttgcttcccaagactggcctgaggtcactaagtatgcaggattagttagcgcccaagcccataggcaagagttgatacaggatcttttcaaagtatggcaagatccccaaagaggaactgtgactggtggcatgatcaagtacgatctttgtaatctcatgatacacatcactcctctagtatctattgctgctaacagtgtaaattctgttaaattgcagggagcttctcatttctttcaagagggcaactggacagaaaccccagagaatcatattttacaggttcttatccttgcttgggcatgtttggtaaacacaattgtctgttattaaacaattagtattttcagggatggtgtcagcgagggacagttctatcaagttcttttgtatgaacttgatgccattagaaaggtagaattgcttcgttcatgcttttttcttgataaactctgaccagccacacttgtttggcaatactcagcatatatctctaactgttatttcttaactacatgtaggcatgtgcgtccttggagcccaattaccagcctccagttacttttgtagtcgtccagaagcgtcatcacaccaggctttttgctaataaccacaatgatcagcgtactgttgatagaagcggaaacatactgcctggttagttgtttgtacacacaagctgttttctgctttgctactcaattccgaatctgacgattgtggaatggacctctatctatttctaggcactgttgttgattcaaagatttgccatccgaccgagttcgatttctacttgtgtagccacgctggcattcaggttggtactttatttgcagtctgcattttgtcgaatttctgattgctgatttacctcttaattcctttcagggaacaagccgtcctgctcattatcacgttctatgggacgagaacaaattcactgctgatgagttgcaaactctaacaaacaacttgtgctacacgtaatttactgtcttgaacttttttagtttaaaatgttctgtttaactggccccaactgaagacaatctctactgtttcaggtatgctaggtgcacccgctctgtatcaattggtaagtcacaatacgattctcacgctatcagtgttgcgtaaaacttgcgttgcactaccaatgtttgaaaatttgactctgactattgcgtttgcttgcagtgcccccggcatattatgctcatttggcagccttccgggctcggttttacatggaaccggatacctctgacagtgggtccatggcaagcggtgcccgtggccctccacagggtggacgcaataccaggccgtttgggaacgttgctgtcaggcccctccccgccctgaaagaaaacgtgaagcgggtcatgttttactgttaa

SEQ ID NO: 967 - DNA, 7663 bp, Triticum urartu
tcgtttttacgttgtccgcgctagcttgctcgtagatctaccagtatacgattgtgatggtgcagttttctcccgctctgctttcgtttttctccatgcgacgtgcgtctccgaccccatccatccatccatggatgcttggtcgagcgctgtcgctacacgtagtgacgcctcggtgcttctctcttttgccgttataaaatctttgcgttttctcccgctacatgcatggatggttttctcctgttctcatgcatgaacagtgagttcttggaatgcaaaagccatcctgcagacagtagctatcgcttcttgtttcgtcgctgtcgttgttatcttggaaactagcagcagtagatgtagacattatttcggcaactttgcggtcaaggctgcagattcttgggatccgttttggctatagacggcagggggtcgccgtgagatcccgtcccatgcaaagccacgtacctttttctttctttgattcatctcctgtgtcttttcccggcgttcttcttttgtgaaagtgttttcggggatggtcttggtcttgtggtttccgtctggtccttgtcctcgttcggggacagaagggcaaagcaacgaacgtaccatccgtccgttgggacatggcagacgcatccgtccgtccgtgtacgtgtctttcatacattttgggcaaagcaggaggcctgttggtgttgttgcccttgccacctttgtttgtgattcctctggctctgccctgcctgcatgcatgaggtcccgcggcagcttttggttttgtctttggttcaaagcatgcaacgccgaggccgtgctcggatctcctgtgtcgcgcacctcgagcgcaattccgtgtggctctctgtgtttgcatctagtccgtcaactttcttttttgggagagattcttttccccctctcggtccagccttggacgtttcctctttgtgtatgtatgtgggtggaacaacagtggtggatctgtttttttttcgctgaatggtcgacacgtacggggatttaaatattagtactgtttttgacgtgaggtttaatattattgtttttcagctttttacagtgagctctattttgctttaaaatctcattctctgctcatacatgtatatgcgtacctcctttgttgccaaactattttatattccaaatgcaaaaaaactactttatattcgtctagtacatttatatatggtaaattgacgacaaattattttgctactcctcgtaacaagtacccctacagtatctggtatacagtccgtagttcctttcccttttttaagtacatatatacagttcgatgcaaaaaaaaagtacatatatacagtacgcaggtccttttttttactagacgcagtacgcaggtcaggtccttttttctatactatacacacggtacacaggtccgcttattgtattcctgtaccgcatgattgcaccaagattcgtgccctcgcacccacccccaccatgccgtcgcagcctcccactcaacccctcctcacccggacggagcgccgccgccccttctccgcctccggcctgctcgcccgcggcccgtcaggaaccctagcatggccgtgccagaaaattactctactgtgctgtgcccccttgagtattgggagttcgatttgggatccagacttcttcccccacttgattgactctatactacagggcttcttccgtttcaactggatttttttctggtctcagtaagtcgaaatggaggccggcacatggtatgtcttgccgtttgcctgctacatttccagtcctgcgatgccactagcagctaatttcgtttattgcctaattttggtttactggtttcttaagatccgctagtttttcttttccctcacagattgaatgaagtatagcataagtactgagaattaaaatatttcatttgattttttttaaattcattggacactaatcagagggctaatcgtctctattctgtgtactgaatgtagaacagagtctctcttgtttgtgcatacatactgatgttgaaatgtgttgctgtaggtctccattaacccggagtcaaaatcaagggctgtgaacagggaggtactcagtgagctaatcaagttgcacggcaagacatcccttgggggcaaattgcctgcctacgatggaagaaagagtctttacactgcaggctcactcccttttgagtctgaggagttttctgttacactggttgatcccgaaaagaaagacaaagaaaagtatgattggattctttaccttcaatcttgtccaacttgattacccattgtatttgttttttagctactgacttgttccctcttcatttgcagggctgaaagggagtacaagatcaccattcggattgctgggaggacagacctgtaccacctccagcagttcctcaaaggaagacagagggatatgcctcaagaaaccatccaagttcttgatgttgtcctcagggagtcaccatcctggaagtatgacatccactttccagcagtttattgccatcagtttttcttgatcatactaactagttctctagagccctaacactattgcacttttttcattgcagctatgtcacagtgtccagatccttcttctccaccacctttggtcacagaggagacattggtgaaggattagagtgctggagaggttactaccagagcttacgtccaacccagatggggctgtcactcaatataggtactcccctcccctcccctgtctgttactgttactgttttccgattgcagtgtgtcctagccttgtttatctgatgatctgcacttcatttttcagacatatctgcgacatccttcttcaagcctgtgacagtggtccagtttgtgctagagttcctcaacttacgtgatgcctcgcggcctctgacagacagggaccgtgttaaggtactattcgtctatgctaagctagttttagaattcatgttctgtagattgcaccatgttattgtcttgaaatagttgactaatctcattgtatgcactgtatgcagataaagaaagcactccgtggggtgcgtgtcgaaacaaaccaccaggaagaccaaatccgaagatacaagataacagggattactcctgttcccatgagccagctcatgtaaataacttccctcaaatgctataatattttccattatgtattttctctctatgttctggtccaactaatcagggttgctggaatattaaaaagatgtgtagttgtatagatttttggcttattgcatcttcattgatgttggtgtgtcaggaactggttaggggattaattttgtttacaacattcttcctgtggcatatgcttttgatttctgcagcatagcaagatctgtttgtgccaaattgtttcctgttcacagttttccttaggaatgtctagaccacagttaactttttagcatctatccatgattgttattccctttctaatagcactctactcatgttgttttgtttgttgttagatttcctgttgatgagagaggaacaagaatgtcagttgttcagtacttcatgcaaagatacaaatacaatctgcagtatacttcttggccctgcttgcagtctggaagtgatgctcggcctgtgtatctgcctatggaggtattgtgtccatgcctgcttcgtcatatttgaattatgcattgtttgctcatggttctctacaaattgattgtaggcgtgcaagattgttgaagggcaaaggtactctaagaaattgaatgacaagcaggtcaccaacatacttagagctacctgtcaacgtccccagcagagggagcaaagcattcgtgaggtatgtacctgttgtcaactgcattctggaaatacctgcccatgtcttctcgcatgtggtagttcattccaatctgttcgaactcatgtagttaggaatgtccttttcaaggcatatttgtcatgtttgcctgtaatgtgtagtctttctcatgacactctttttcacactgtagatggttctgcacaacaagtatgctgaggacaagtttgctcaggagttcgggatcaatgtctgcagtgaccttgtctctgttccagcccgtgtgctgcctccccccatggtaagaatgctgtatttccctcctttctctgagctgcttcactagaaggatttgtagtaatcacatcctttctatgtgtttcagttgagatatcatgattctggaaaggagaaaacttgtgcgccaagtgttggacagtggaacatgattaacaaggtatttccctgttcattgtcttcactcccaattttactatgcattactttttcttggaactaaatacatggagaacctgttgtgtttcttctttgtttgttgttaatgtcttggacaggtcattattttgtactgtatgtagcaactcaaattattttgcttgattgcattttattgatcatgtagttttcacactagttacttaaattgagaaacagttgagcttgtctgtgactttgctcgtcattttgtatgtagtatatcgatgatggtacaaatgataggtctcatttgagtttttttactgcagaaaatgatcaatggaggaatcatagacaactgggcctgtgtgagtttttcacgcatgcgtcctgaggaggtatacaggttctgttgtgatctgattcagatgtgcaatatgactggaatggtaaaaggcttgcattgctttcctgtttctcaggcatttatgatttatgtgtgtatgttatagctgactgacttgtgttttccaaccctgtagtctgtcaatccaaggccacttgtagacaaccgatcagctagccccaaccacatcgagaatgccttgagggatgtatacaggaggaccaccgaaatgcttggaaaacagggaagcgaaaaacagctacaactgttaattgtaatcctacctgaagtcagtggttcttatggtatgcatatggctcctctggttaatccccttccaccttctcttggatttctgtagatttatgtgtgtgccacatttaattttgcagggaaaatcaagaaggtttgtgagactgaccttgggatcgtgtctcagtgttgcctgccaaggcatgcttccagaccgaacaagcaatatttggagaatgttgcactcaaaatcaatgtgaaggtaacataaccacctggtctatgttttacattcagtttccatggaatgttgattcattgtctacttcggtttctgttgaatgtgataattctgtgtcttgactaggtcggaggacgcaacacagttctggagagagcttttgtgcgaaatggcataccgtttgtgtccgaagtcccaacaatcatctttggtgctgatgttacacaccccccacctggagaggactctgcatcatcaattgctgcggttagttcttccccgtagctaacagtttgtcaactcgttatttgtttctttctgattttatctttcaaatggaattatcatcttgatgcacatacctgttgagtacaaataggcttaaccgtttcttatattggattgatgtaggtggtggcatcaatggactggccagagatcaccaagtacagaggtcttgtctctgcccaaccacacaggcaggagataatcgaagacctcttcagtgtcaccaaagatccgcagaggggtaatgtcaatggtggcatgatcaggtgagttttgtgattagtcagagacgattgctagcaattgccctgtggatcaactgcgaacctgacataattttctctacagggagttgctgattgccttccgcaggaagacaggccttaggcctgagaggatactcttctacaggtgcgtgcacaaattcatgatactcttttcatcctgtccattcaatggaactgcctgaccgatcattctcatgtacagggatggcgtaagtgaaggccaattcagccatgttctgcttcatgaaatggacgcaatcaggaaggtaagcctgcagcatatgataacgtgcaaatatctgttttgtctacctcttctgatgttatccttggcttttctcattctgatggttcttaattttgctgttgcaaggcctgcgcctcgttagaggaggggtatatgcccccagtcacctttgtggttgtccagaaaaggcatcacaccaggctattccctgaggttcatgggaggcgtgatatgaccgacaagagtgggaacatacttccaggttagcaaatacactggtatttcaatgtcactgatttacacctatctgctacttgttgaaacattgctgactgtgattgggtgcatttctgtttctgttgtcctgcaggaactgtggttgacctcatgatttgccaccctacggagtttgatttctacttgtgcagccatgctggcattcaggtagacactttgtccacatgtccatttgttcctatgcagcttatcttcagtgcttgcatactgagtgtgtttgcaaaatgctcctcagggaactagcaggccaacacactaccatgttctttatgatgagaatcacttcacagccgatgcgcttcagtcactgaccaacaatctctgctacacgtaatcccctctcttccgctctctcttaatctctctgttgtgttatgactctgatgatggtttaattatgatccatatgcagctatgctcgttgcactcgtgcggtctctgttggtgagttccctttttcagttttctgccttgatttgcttcaactttcatctgtactttttctctccaagtagagcattcttctgtgggcattaatactagtagactaggggcatcatctgccttatgcctctgctattaaattattatgttttgcttatcctgatagtcctagcagctgcagacttgtactgtatttggcattagtattaccttgtacccgcctgtgtgtgccactgtgccttctctgatgcaagttagcaatccaaccacactggtttctttaactccttaatggatctgtgcttgagggcctttggtctaaaactctaaataagcatgtactcctgacaaaatgaacctgagtttatagatgaatacaccgagtagtttcattcctttgctagtttattgatgaatacactgagtagtttgcattcctctgctagtttattgatgaacacactgagtagtttcattcctttgttctgtgtcatctatatatgtttacattgaaatcaaccctctgctagtttattgatgaacacactgagtagtttccattccttcgttctgtgtcatctatgtttacattgaaatgaacaacacagcatctttcccccttgctgttttaagacttggtaacctagctgttgttctatttatacaacctgtggcatttacttccagaagaagctaacttggctgaacttgctatgcagtcccaccggcctactacgcccatcttgccgcattccgtgcgcgctactacgtggaaggggacagctcggacggcggatcgacccccggaagcagcggtcaggcggcgattgcgcgtgagggccctgtggaggtgcgccagctcccaaagatcaaggacaacgtcaaggacgtcatgttctactgctga

SEQ ID NO: 968 - DNA, 11324 bp, Triticum urartu
ggcgtgcgtcgtggttgaggccgccggatcgacaagcggggtaaccacatgagggtcaccagcgcttgcaacacccaatagtgcgctcatctcctccgccttagcacataatctctttagataccacaacaactgctcattggcagacatggtatcccacttcagtggtaagtcggcaggcatggcgtcatcgtcggtggaacagatgaattggcgtggaagaaaaaatgagaaaaattagatggtggaaggatggtggcctggctttgaataccagatgttagggactagctgtagtcttgctagtaatctctctctctcaggaaggtttgatacagagtagcaattacaaccagaggttacaagcgaattgggggagaacatggaagaactggaggtaggggaaggtagccgccgccaagccgtccgtgatccactggataagttgtgtgttgcttttgcccacatacttgtggctgcagcggccagaggactcccagccgggccaggcccatgtgatgtccagaggcaagcttatatgggctaggggagagccctgacaaaaacatggtttaattgcttgggatccggcaaaacgcaagggcgggggaaacgggaaaatttgggttttcgctgccccttaagttgtgtgttgcttttgcccacatacttgtggctgcagcggccagaggactcccagccgggccaggcccatgtgatgtccagaggcaagcttatatgggctaggggagagccctgacaaaaacatggtttaattgcttgggatccggcaaaacgcaagggcgggggaaacgggaaaatttgggttttcgctgcccctcccgccaagcaaacgcgcccagtcccgcgtgcgccgcgcggccaaaacctcaaaaaacccttcccaccctttgccccgcctcacgcacgccgcgtcgcaattctctcgctcgcgttcgtcacccctccgctataaatcccgccaccacgcgaccgaaacccccctccccccctcggatccgctccttcggcctcgttcccccgtcgcctccgccgccgccggcgaggaggccgaataggtaaccctggggcttcgttttttcttcttctcggtcctgtttttaccgtgcctgcggattgattagttcggggtggtgtttaggggcgcgcgtgctccgatagtccctgggctccgtgctgtttgaccgacgattcgtttgcgctgctgctctggctccgcatccaggcggggttgatggattccttcggttcgttgtggatttatcagtgacggttttctagtggaaacatttttgccttgcctgctgttctagttctgtattccgctgcggatttctttgatttctgtaccatctactggaggtgattccggaaaggttgtcggtgtgttgccgcaacgcagagcagagttaacggaatggcgaccgttccctctgtaaccgcgcctgcccctatttgggccatttccgccgtatttcctcccgtgtatcatactcatctcttcggatgtgcgtcgtgggggcttagcttgctggtctgtggtgcggaagtagctccatctgtgattgttcgctgtgcttagctccggggagccctgtgcgtctgcctatccatatagttagtttgtttgatgtgttctgtgtagggggttaggagactattttcagaaatccgttggtctgcttgagcagtggtggttcatgacttgattattgcagttcctaccaaaaaaacccaccgttttcttcaatagttctgcgcctcccccaaattggttaaacttctgtttaagtagatatccccccaccggtgttgaagtttctgatgtttttttttgatcgtgctgcattgcaggagtacttgcatacttagtggatccgtgcttggtggcattgagattcaccgcaaatcttctgtagccttaatttgccttgactgcctgcagctggtgatttttgttcttgagtatcctaggtatgtgtcactaattccatgcctatttgaatgaatgaattaactagaaggcttcagctctgttcattttgtttatggctccactcctgtgacaaacatctgttaatcaagctctgatgtgtcctatggccggtgatgcaattttaggaacagttcattaccttactgttgaattagttaatttgcttacttgtagttgttaataaggtcttgtaatggaatatagacttgcttttagcatgtcttctgaagtttcttgctatctttgtgtagaggagctatatatctacatggattagcacacagttttcaaggggcacctggtgctgctagccttgcttttgctttatttggtggcttggtgcaaccacctgtgctgatagttttggtgcacctttcttcatttgcctattcttagcttattacttggggatcttttgagaattgccatgctgagtgctacttccccagttgcttactcacggttacactggtttcatgctagttttagcatttgccaatgttttcatgtttgtgaaccaattatagtgtgatgtaataatgagatgttagtgccatgattgtttacttttgatttggaagacatgggtttaatgatggctatgttgtttcctaccccctattgttgctagaggttgaggtctactcatagattatcattcccaaaggcaaaatcaagttgtctaaatcagttaaaggaattggatacaggttcaacagattgttgatgtgtatgtttcttattcattaccttttgcttctgcttccaatttggaattgatcttctacatgttgcggggttggctctataacatgtctagtgattttgatgaagtgtgttgctctgttaatcttttcatgtaattaagtttggattggaagtaagtactgtattttcttgctaattgttgatgaggctgactaattctgaattttacagggatatatcaaatatggtgaaaagtccacgttctccagttaccacaggtattgttcttaattacttctattgttacttgttttgcatgactacagtagtcacctttccaatctatagcatggttatatctgtttccaggaatgtgtaatatgatatactcaatgctatcagggtattttccgtgtgcatctgctttgaaaatgtgaatttcaaatgttgtctgactcttgttttatgtttaatgtgttacatgttggtatattctactaggcactgcaaagaaagttatgacatttctttagaaaaaactaatgctttacccttttaaaacaagtattctgctttgcgttcatatataacagtgcaaaggagcaaattatatgctgacatagacatgtcatatgtgctaatgtttctgtgatgctcactagctagacatggcataagcaaagttggtttcttgccatgaattaaccagtattgacttttgtattagatttgtataaaatattaatctgtatccttattgagtgtctgggcagtcttctagtttgtctaatgtgtcttatatggagctttgactcaaactggatagacatcaagagggagatcgcaaaccacgtacccattgctatcactgctctccattgctgactccacttcctatgttatcactaaaatgaagacagacattgtggtacatgcacaagtctgcccttcattgttaaagttgaatggctggggaggaagatgatgtagatagattgtttggttgttattgagatgatggaaattgtggagctgtggtgttgagagggtgaggcgcattatgccatgaattgcgtgtggtggataggtgccaatgctttccttttcctctttttctgtgccctcccaggtttggttgatctatttgcatattagttatctagtatgtgctgcaacttgctttaactaggtgttttgatagcaatcataatgctaatgcatacatgtgaagatgagtgtattttaggattgtaggatgaagggtggaataagctactgtccatgtttagtatgcaaaatagataatgacctaaatctctgggaagaaaagttgtctagtttggcatccacatgttgattttcttcccattgctcacctgcgtgtgcatgatactgatcgaggtccttaggttatactgatatttacatggcattagtccagttggttatgagatgccattttttgctgaatgttgagttgttgacaatgcagcttcacacatcacacataaaacaagaaaaccattttttaaacataatttttaatactaacatacatgcaacattttgtataaatcatcaatattttaatggcacacacatactgtttgcagcataaaatcctttatacttatgctttacttggagtggtatgaacacttggagcatggattggtttgactcatatcacagtactacaaaaatatgattgtgtttttctgcaagaaaatatgattttgtttgactcgtatatccagtcgtagtctgttgaatgtgcttttacttttatcaacctagtgccttgactgtgaaactaaattcaagatataaatgaggtcacttatcttgtgtccatgctagtgttccttggaagagagaaacagttgtgaaagtaatgcctggttctgtacagttgcccttctaatgagaacttatttctagatgaacttaatttgaacccccaagtacatgaataacagggtcaggtgatcaatgtatgtatgtaggtgcacacttaaatcctgtgtatgaagatccatgtaacctcaacaagccatcatgcatgaagatccacttctgtgcactttttatatacgttactggattcaagactgcttttaatgctatagatcatcagcatatttctaattccccttcttgttaattgcctatatgcatatggcttatgcttcatggtgtttgattggtttttattaatcaatttaatgatctaattctgaagtttcatcaagaatcggtcttgtggctatttaagttccctgaaaaggttaagtgtcatggtctttgttttcaagatgagcctctgatatcacctagtgacttgtgtatttttatcagataaaagagctacaagttgcaactgcaattttcactgcaggggttacaccaggaaaacacaaaattaaccatataatataaatatagatataaatgaggctttttttgtgccatctgatcttggtgtctgggcgatatctacaattttgcttgtgtgtgtctcgccatagatcttgttggagctttgtttaatgatagctggcagcaactgcctgtaacttatacagtgaacatctgttctgtttcttcataccaattggcagttggcacccctagcactttcctttttgttaggaaggagatccatctatataatattagtttccaagaaatacacaaaaggcttgaatgccatttcatgaaaaagaatatcaaagaggtttctgcatgcctcattgaggctaagcaatcatctcctaacacctgtcttcttgtgtctgctgagtgctggcatcgttgccagtcaagcttgtggaaggcagccaagtctaggctggccagctctcatgcctaccagttatggacccaatcccattgctgtaacacctgagtgctgtgtcattgtattattgatgccttttcactgttcatcatttagtttctttcttttgttcctgatttagttattttatctgaatgatggcctttcaggaacaaaaaggtgcagagcaaagccacaaaagaagggtgaagaattcactgcacaaggaaaattggtggatgggcctcaggatgcaacaaatggtgttgaaaagggtgctggttctgctactcacaagaggccaaggagggcagcagcctgttctgattttaaggagaaatctgtacgtttatcagaaaaaacttctgttgtcaagatcaagaaaaatcggatggaagaggaagaaatagatgcaatcaacctgacaaaattagggccagaagattcgccgccttgccggaagttgattgatttcatcttgcatgatgcagatgggaatctgcagccatttgaaatgtctgaaatagatgattttttcataacagctctcatcatgcctatggatgatgatctagaaaaagagcgtgaaagaggtgtacgctgtgaaggatttgggcgtattgaggactgggcaatatctggttatgatgaaggtactgcagtggtctggctctcgacagaacttgctgattatgaatgtgtgaaaccagcaagcaactacaagtcttactacaaccacttctatgagaaggcacaggtatgtgttgaagtctacaggaagctcatgagatcagtaggtgggaatcctaacatgagtctggaagaattgcttgctagtgttgttcgctctgttaatgctatccaaggttacactggaacaatgagcaaagaattcatgattgccactggtgagtttgtatacaaccagctcattggtttggatcagacggcaggcaatgatgatgagaagcttgttacattgccagttcttcttgctctaagagatgagtgcaaatctcgagcagaatttaccaagatgccacttagcatttcaaatgggagcctgaagatcaaggatattgagtgtaaagaggtagctgaggacgatgatgagaaattagcaagattattgcatgaagaagaagaatggaagatgatgaagaaacagaggggtaaccgtggagtcccttcccagaaaaatgtctacatcaaaattagtgaagctgagattgcaaatgactaccctctgcctgcatactataaaccatctagccaggaaatggatgaatacatatttgatagtgaggatggcatgttctctggtgatgtgccagtaagaatcctcaataactgggctctatacaatgcagattctaggcttatttctctggaattaatccctatgaagtcaggcgcagaaaatgacatagttgtctttggatctggttttatgagagaggatgatggcagttgctgttccacagctgagtctgcaaagttgtcttcttcatcaagtaaagctgataatcaggatgtaggagttccaatatatttgagcccaatcaaggaatgggttatagaatttggtggctcgatggtttgcataaccattcgaactgatgttgcttggtgagtaccccagtcagtttttactgctattttattgtgtaatcttcatgccactgcctgttcagtattcttttcactgaatcctctcattcctttaccccagtctttatttgtttctgtcggcactccattagaacttacattgcatgtattttcaggtacaagctacggcagccaataaagcaatatgctccttggtgtgaacctgtactgaaaacagcaaggcttgctgttagcatcatcaccctgctaaaagagcaaagccgtgcttcaaagctttcttttgctgatgtcatcaagaaagtggcagagtttgacaaagagaatcctgcctttatatcgtccaatattgtactggttgagaggtacattgtggtacatggacagatcatacttcagcagtttgcagatttccctgatgagacaattcgacgtagtgcttttgccactggcctgttgatgaagatggagcagagaagacatacaaagttgttcatgaagaaaaaggctcaagtaacaagaggagagaatctgaatccaattgcaacaatgggaacatcatcaaaaagaaaagcaatgcgtgcaaccacaacaagattgatcaacagaatatggagtgattactatgcacaccatttccctgaagatttgaaggagggagatggaaacgaagcaaaagaagttgatgatgaacaagaagaaaatgaagatgatgatgctgaggaagaggtacagattgaagaagacaaggttgcaaagactccaccatcaacacggtctcgaaaattggtatcacaaactagcaaagaaatgagatggaagggtgatccagctgggaaaacaacttctggagaagctttatacaaatgtgcgtatgcacgggaactcagaatagatgtcggaggggcagtcacactggaagatgattctggagaaatagtcatatgctttgttgagtacatgtttcagaaatctgatggtgcaaaaatggttcatggaaggattctgcaaaaaggctcagaaactgttcttggcaatgctgcaaatgaaagggacattttcttaactaatgactgtttggagtttgaactaaaggacatcaaagaattggtctctgtcaatctccaatcaatgccttggggtcacaagtatagaaaagagaattctgaagctgagaagattgagtgggccaaagtggaagagaggaaaaagaagggtctgcccatggaatatttatgtagaagcctgtactggcctgagaagggtgccttcttctctctacctcgtgataaactgggtcttggtaatggtgtctgtggctcttgtgagcacagagaaccggactgtgatgaattaagaatacttaccaagaccagcttcatttacagaaaggtaacctatagtgtccatgacttcttatacattaggcctgagtttttctcccaagaggaggatcgtggcacctacaaggcaggaagaaacattggcctgaagccctatgcagtttgccatcttttggatgtctgtggacctgctggttctaaaaaagttgaccctgcatcaacaaaagtcagtgttcgaagattttatagaccagatgacatttcaactgctaaagcttatacatctgatatcagagaggttatactcttcttcctctatatatttgttttatgtctgatatctgtaataccatcattagttccatgcttcataacatgccaaagttttgtgatcattctccttaaatagtcttcaatacatattgttaacctttttttgcttgattcaggtatactatagtgaagatataattaatgtgccggtggatatggtagagggaaaatgtgaggtccgaaagaagatagatatctcaaattcagaccttccagtcatgattgaacatgtattcttctgtgagcatttctatgattgtgccactggggctctcaagcaggttagttggctaatataacattttgatttagaactgctagttttggtatttaactgaatgtatgttctgccttgacagttgccttcaaatgtaaagctcatgtctgtggctcgcaaggcaactggtgctttgaaaaagaacaagggaaagcagatctgtgaaaataatgaagttgattcaggcaaatggatggaggtgcccaaagagagccgtattgcaactctcgacatttttgctggctgtggaggtttatccgaagggttgcagcaagctggtatgcacttccttcagtggtatggtttagcatgaaaatgttggtcttctgactgatttttttattattcattgttaaattctgcaggtgtgtcatttacaaaatgggcaattgaatatgaggaaccagctggtgaagcatttaggcaaaatcatccggaagctgctgtgtttgtggataactgcaatgtgattttaaagtaggtgaaattgtttaatttatgtgctgtgttgcatttatttatttgtgtagctcaatcaagattgctttgtgacgatgcagggcaatcatggacaagtgtggggattctgatgactgtgtctcaacttctgaagctgctgaacaagcagctaaacttgctgaagagaatattaaaaaccttcctgtccctggtgaagtagaattcataaatggcggtcctccctgtcaggtacattatattgctataagcactggtaagcagtttgttgttcaaaatgttaacccattatttacctatgtataccctttttctgttaccagggcttttctggcatgaacagattcaaccaaagcccatggagtaaagttcagtgtgagatgattttagcattcctctcttttgcggagtattttcgtcccagattctttcttttagaaaatgtcaggaattttgtttcgttcaacaaagggcagaccttccgactggcggttgcatctcttttggaaatgggataccaggtgctaattcttgccattgtctacttaaactacctagttagcacttctttgaatctgtatactgagaagttgtatacctgtttaggttcgttttggaatcttagaagcaggtacttttggtgttgctcagtccaggaaaagggcattcatttgggctgctgctcctggagagattcttcctgattggccagaaccgatgcacgtgtttgctagccctgaactgaaaataacactgcctgatggcaaatactatgcagctgccaaaagcactgctggtggggcacctttccgtgcaataactgttagagatacaattggggatttgccgaaagtggaaaatggtgcaagtaaactcgtacttgaagtaatattccaaggccattcagtttttcttttgtttctgctctggattcccatatttagtgaattcctctcttaatgcagtatggaggtgagcctacctcttggtttcagaagaagatcagaggtagcactattgcattgaacgatcacatatctaaggagatgaatgaattaaatctcataagatgcaaacatattcccaaacgacctggttgtgactggcatgacctgccagatgagaaggtaaatgagactgtcctactctgtagctgcattcactgtttctgttgatccctttttggtgtttgtgatatgttaattccccgaacatacatgtgcaggtgaagctatcttctgggcaaatggtggacctgataccttggtgcttgcctaacaccgctaaaaggcacaatcagtggaagggtctgtatgggaggttagattgggagggcaatttccccacgtctgtgactgatcctcagccgatgggcaaggttggcatgtgcttccaccctgaccaggataggattatcacggtccgcgaatgtgcgcgatctcaggtaagcttaaagctgctctgcatccatcctcatctgattacaaataacctcgaatgtgttaaagattgttgtaaggcatggtaaataatctgatttgaacctatcaacgtctgcagggctttcctgacagctaccagttttcgggcaccattcagagcaagcacaggcagattggcaatgctgtgccaccccctcttgcctttgcgcttgggaggaagctgaaggaagccgttgatgggaagcaccagcaggcctga

SEQ ID NO: 969 - DNA, 3552 bp, Triticum aestivum
ccgaacgcgagggaaagatcatttctactgatagtcataagatacttttatcaagtagtgggaagactataagtattcctttagttaaccaccgtcgctctaacaaaaatacttgtatgcaccaaaaacctcgggttccacggggtaaatccattaaaaaaggacaaattttagcagaaggagctgctacagttgggggcgaacttgctttaggaaaaaacgtattagtagcttatatgccatgggaaggttacaattttgaagacgcagtactaattagcgaacgtttggtatatgaagatatttatacctcttttcacatccggaaatatgaaattcagacggatacgacaagccagggctccgctgaaaaaatcactaaagaaataccacatctagaagaacatttactccgcaatttggacagaaatggagttgttaggttgggatcctgggtagaaactggtgatattttagtaggtaaattaacgcctcagatagcgagcgaatcatcttatatcgcggaagctggattattacgggccatatttggccttgaggtttccacttcaaaagaaacttctctgaaattacctataggtggaagagggcgcgttatcgatgtgaaatggatccaaagggacccgctcgacataatggttcgtgtatatattttacagaaacgtgaaatcaaagttggggataaagtagccggaagacatgggaataaagggatcatttccaaaattttgcctaggcaagatatgccctatttgcaagatggaacacccgttgatatggtcttcaatcccttaggagtaccctcccgaatgaatgtgggacaaatatttgaaagctcactcggattagcgggggatctgctaaagaaacattatagaatagcaccctttgatgagagatatgagcaagaggcttcaagaaaacttgtgttttcagaattatatgaagccagtaaagaaacaaaaaatccatgggtatttgaacccgagtacccgggaaaaagcagaatatttgatggaagaacaggcgacccctttgagcaacctgttctaatagggaagtcctatatcttaaaattaattcatcaagttgatgagaaaattcatgggcgttctactgggccctactcacttgttacacaacaaccggttagaggaagagccaagcaagggggacaacgagtaggagaaatggaagtttgggctttagaaggatttggtgttgctcatattttacaagagatacttacttataaatctgaccatcttatagctcgccaagaaatacttaatgctacgatctggggaaaaagaatacctaatcatgaggatcctccagaatcttttcgagtgctcgttcgagaactacgatctttggctctagaactgaatcatttccttgtatctgaaaagaacttccaggttaatagggaggaagtttgatcggaataaatataaattcttttcttatttctattttatgattgaccaatataaacatcaacaacttcaaattggactcgtttcccctcaacaaataaaggcttgggctaacaaaaacctacctaatggagaagtcgttggcgaagtcacaaggccctctacttttcattataaaaccgataaaccagaaaaagatggattgttttgcgaaagaatctttggacccataaaaagcgggatttgcgcttgtggcaattctcgagcgagcggagctgaaaacgaagacgaaagattttgccaaaaatgcggggtagaatttgtggattctcggatacgaagatatcaaatgggatacatcaaactcgcatgtcccgtgactcatgtgtggtatttgaaaggtcttcctagttatatcgcgaatcttttagataaacctcttaagaagttggagggcctagtatacggcgatttctcttttgctaggcccagcactaaaaaacccacttttttacgattacgaggtttattcgaagaggaaattgcatcctgtaaccacagcatttctccctttttttctaccccaggctttgcaacatttcgaaatcgggaaattgcgacaggagcaggtgctattagagaacaattagcagatttggatttgcgaattattatagagaattctttggtcgaatggaaggaattagaagacgaggggtatagtggagatgagtgggaagatagaaaaagacgaataagaaaagtttttttgattagacgcatgcaattggcgaaacattttattcaaacaaatgtagaaccagaatggatggttttgtgcttattaccggttcttcctcccgaattgagacctattgtttataggtctggagataaagtagtgacttcagacattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccgacgagggatggtcacaataaagtatacaaatcactttcagatgtaattgaaggtaaagagggaaggtttcgcgagactctgcttgggaaacgggtcgattactcggggcgttctgtcattgttgtgggtccttcgctttcattacatcaatgtggattacctctagagatagcaataaagctttttcagctatttgtaattcgcgatttaatcacgaaacgcgccacttctaatgtaaggattgctaaaaggaaaatttgggaaaaagaacccattgtatgggaaatacttcaagaagttatgcggggacatcctgtactgttaaatagagcacctaccctgcatagattaggcatacaggcctttcaacccactttagtagaggggcgtactatttctttacacccattagtgtgtaagggtttcaatgcggactttgatggagatcaaatggctgttcatctacctttatccttggaagctcaggcagaagcccgtttacttatgttttctcatatgaatctcttatctcccgctattggggatcctatttgcgtaccaacccaagacatgcttatcgggctttatgtattaacgattggaaagcgtcgaggtatttgtgcaaatagatataatagttgcagaaactatccaaatctaaaagtaaattacaataataataataattctaaatataggaaagataaagaaccccatttttctagttcttatgatgcactgggagcttatagacaaaaactaatcagtttagatagtcccttgtggctacgatggaacctggatcaacgcgtcattgggtcaagagaagttccgattgaagttcaatatgaatctttggggacttatcatgagatttatgcccactatctaataatgggaaatagaaaaaaagaaattcgttcgatatacattcgaaccactcttggtcatatttctttttatagagaaatagaggaagccatacaaggatttagtcaggcctattcatacactacctaa

SEQ ID NO: 970 - DNA, 16942 bp, Triticum urartu
tctgaaaacaatatgataaaagatagacccgggggccgtagatttcactagtggtttctctcgagaaaatagcatacggtgagtaaacaaattactgttgggcaattgatagaacttcaaataatcatgatgatatccaggaaatgatcattatataggcatcacgtccaagattagtagtccgactcttgtctgcatctctactattactccacacatcgaccgctatccagcatgcatctagtgtattaagttcatgaagaaatagagtaatgcaataagaacgatgacatgatgtagaaaaaaactattcatataggaatagaccccatctttttatccttaatgacaacgatacatgtgtgtcacttctccttctatcactgagattgagcaccgcaagatcaaacccatcacaaagcacctcttcccattacaagaaaaatcaatctagttggtcaaaccaaaccaaagttcagagaataaatatgatgctataataatcatgcatataagagatcaaagaagactcaaataatattcatagatagaactgatcataaactcgtaattcatcggatcccaacaaacacaccgcaaaaagtcattacatcaaatagatctccaagaacattgaggagagcattgtattgagaatcaaaaagagagaagaagacatctagctattgcctacgaacccataggtctgtggtaaactactcatgcatcatcggaggagcaccaatgaggatgatgaacccctccgtgatcgtgttcccctccgacaaggtgccggaatagggctctagattggatctcgtggttctggaacttgtggcagctagaattgtgtttcgttgactcccctagggtttctggaatatttggatatttatagagctgagaggcggcggaaaggacctctgtgggccccactacacatcagggcgcgccaggggcctctagcgcacccaggtgggtagtgggccccacgggcctcccctctagcacttccttggctcccaagttgtcttctaggcagaaaaaaatctctaaaatgtttcactgtgtttggactccgtttgatatgcatattctgtggagtaaaaacaagcaaaaacagcaattagcactgagcactatgtcaataggttagttccaaaaaatgatataaagttgctataaaattaatataaaaatccaagaatgataatataacagcatggaacaataaaaaattataaatacgttggagacgtatcaattctattctcacacacaagtttcttaaaatcctagacgatgcaaggaatcaacaaatttgcccttaactgctggaagaaaagcaaatccactacataattttctacaaatgattagcgttcagacatgttcattttattatgactaaacttgccaagccaaagcttttgttccctccatattgtataaaaactatgaaagctagcatggcacataacacaccaagaggcaaaaaaaatggagcaagcgtgtcggggtggagaaagaaggttcatcaatgcccattttagagttttgacttgcgacaccgatactagagccaaaaatacggagttcaagcgtcataatgttgatgatctcatgtaataaaataaatatgtttcaaactcgatttcccgcgcacaaattcattaagtattctagttgatgcaaggaatttagcaatccacccctagtatctcaaaagaaaagcaaatccaccaccatcgtacgaatagttaacgttcaaacatattcattttatgcctaaacttgccaacccaaatctttatcggcgccacgaatatagccatgtttttatactacactggtatttttagaaagatacaaagtgcaatgtgctatctttgtcagaatcaatttactacattttaaattcctctttggtttcatgtgtctaaattttgtaggaattccaacacccaatctgaccatgtttccgcaatcgttcacacttttcccatatattggcacaataaatacatttcaaattgtatcatcgctcataagtttcttaaaaaccctagatgatgcaaggaaccaacaaatctgcccttaaactgttggaagaaagcaaatccactgcataattcttctatagatgattagcgttcagacatgttcattttatgactaaaattgccaagccaaagcttttgttcgctccttattctgtataaaactatgaaagctagcatgacacataacacaccaagaggcaacgaaatggagcaagcgtatcagggatggagaaggaaggtttatcaatgcccattttagggttttgacttgtgacactgatactaaagccaaaaatacgaagttcatgcgtcacaatgttgatgttctcgtgtaataaaataaatatgtttcaaactcggtttctgcgcacaaattcattaagtgttctagatgatgcaaggaatttagcaatccacccctagtctctcaaaagaaaagcaaatccatcaccatcgtaagaatagttaacgttcaaacatattcattttatgcctaaacttgccaacccaaatctttattcacgccataatttcgcgccacgaatacaaccctgtttttatactacactggtatttttagaaagatgcaaagtgcaatgtgctatctttgttaggatcagtttactatgtttcaaattcgtgttgggttccatggttccaaattctgtcagaattccagcgcccaatccgattatatttccatactcgttcacatttttcttgtatattgcaaccggtgaatacatttcaaattctattctcgcgcacaagtttcttaaaacccctagatgatgcaaggaatttagcaatccaccctagtctctcaaaagaaaagcaaatccaccaccatcgtacaaatagttaacgttcaaacatattcattttatgcctaaacttgccaacccagagctttattcgcgccataatttcgcgccatgaatatagccatgtttttatactacattggtatttttagaaagatgcaaaatgcaatgtgctatctttgtcaggatcagtttactacgtttcaaattcgtgtttggttccatggttccaaattatgtcggaattccagcgccctgactatgttttcgtactcgttcacacttctcttgtatattgcaaccggtgaatacatttcaaattctattctcgcgcacaagtttcttaaaacccttagatgatgcaagaaatcaacaaatctgcctttaaactgttggaagaaaagcaaatccactacataattcttctacaaatgattagcgtcgagacattttcattttatgactaaacttgctaagccaaagcctttgtttgttccatattctgtaaaaactatgaaagctagcatgacacataacacaccaagagacaacaaaatggagcaaacctgtcggggatggagaaggaaggttcatcaatgcccattttagggttttgacttgcgacactgatgctaaagccaaaaatacggagttcaagcgtcacaatgttgatgctctcttgtaataaaataaatacttatcaaacttgatttcccatgcacaaattcattaagtattctatagatgatgcaaggaatttagcaatccatcccttatagtctctcaaaagaaaagcaaatccaccaccatcataaacgttcaaacctatttgttttacgcctaaacttgccaacccaaagctttattcgcgccacgaatgtagccatgtttttatactacactggtattttcagaaagatgcaaagtgcaatgtgctatactatttgtcagaatcagttcactacgtttttcaaaaaaaaaattactacgggttgtagtataatataaggtggtgtttattttatttatttatcaaattccactagttttataaaagctttatggcggctgataaatgtttcccttaaaaagggccgctacaagagtatataatacacacacccctggaccctggtccaattcatcaaatccaaatctcagaaaagaaaaagccagcacgaggccaggccgtgcgcctcctctcccagactcgctccgctccaggttcgtgttcgggtaatatcctcctgactgacctctgcagcgcccgctgtccgactcctctctctctctctctctctcagtcttctttgatcccccgtctgccatttggaccgaggaagaaggcgcagtgacgtcagggaatcaggccgcttctcccggtggactgcccagaaaaccccggctctggtggcccgcccgcccgcaaatgcccaaacccccaggtaggtggagcgcggcgcccgaaccccgagacggctagaaatattcttccttacctttccgcaggtgttcgtccgactctgaaccggttaggattcagagagagattctctttagtttaccgttctccgtgccgccctcctcctcttcgtctccgtgccgccctcccccttcgctctccctcgcacgcagattgctgcgccggcggcgtcggcaccctctgccgctcctgggattcgactaggggcgggttggttccgtccttcgcaggtgaggcgccccggctctgcctctccgtggaggatttttcgtaggctattttgttttctggcttggacttcgatcctgtatttattttcctataaaccctcttcggatcaaccgaaccgtgctgtcaaattcctgttaattcgtttcctgtgtccaaattccgtaggaattccagtgtccaatctgaccacattctcgtactcattcacgtttctcctgtaaattggtactggttgtcagttcgtgccgatggcccgtttgctccggttttgctatcaactgtccgatttgatacgagtgcctgggattgagatgcgattcctgtttccgtagcaatgcctgtagcagtttgctgttccatcaaactatttcttcctgtatcaatgatttagattagattctgttccttttcgtgtgtcatcatctacttctgtcagtacatgacattttctatgtgttcgttctgcaggatggaggagccaaatgctgaaatgggaatgccaaccggggagctgaaaggcatcacattctatctcatgaccaatacagagatggtaagcttttgctttttgcccccgaaaagaggaatatacttaaagctgatgtgcatttccaggaaaagtcaagcagcgtgagcattgtagaaccatctgatgtcagtagtgccaagttgggactaccaaatggggcaccacagtgtgagacttgcggagcgcagagtgtgcgtgaatgtgatggtgagtaatattaagcattcagcatcaaatttatgtggttgttcctaatccaaaataaattgatgtgtccaaattttaggtcattctggcgtgattaagctgccagcaactgtgttcaacccgcatctattcgaggaagttgttcagttactgaatcagatatgtcctggctgccacactccaaagcagaacagagattcaaaggtttgtaatagccagattaacctacttcatcctgatttaccaatttattctctttaatattttaagggtatcataccttatgggtcatagcgcctctggacaataaggtccttgttaaaaaactctcattgttgatctgctgaactaatgtcatggtgctaagtcctgcatacaaaataaaagtccataaaacaaatatcggtactgctgtcatagctagtgcatcttttcccatgcctaacgtatctttaaacaaacttctgcaatgtggaaactaagctttatactgattactaacattttatttgtttgaacatttggaatttgtgagacaagatatttacatttcaaaagcacatcagaagatatgtaggcattgcaatacataatatagaaactatgcatgcagaagcatatctcgtttttggtataccgggttggttcatatttattcctctaacatgttgatttttgttgtcgaagaggtcggatggggcaacaagtcaagcaacttgcaagtattgctcagtaagtgcatgttcaacgtttgggcctgtaattctgccctatcatattaaaccttgacccttttttgctgaacagaaggatggcactaaacaataccccgatgtaatctttaagacactgacaagcccaagaatgacactgtccaaggctaaacttcaacgggatcctagcgttatggacaaaatttcgcttactgcagaagttgctgacagagtgactgattcagctgaagttcttcccctggactattgggatttcgtacctcatcaccacccccctcaatcaaatatgaccaagatattactgtctccataccaagtaagtactccctccgatccatattaattgtcacagctttagtactccctccgatccatattaattgtcgcagagtatttgctattcagtaacattagtctgttctgtgttggcttgcagagcagatttggttttgctgcagcatcgtttcctgtttcttcttttgagaaaaatgttctatattattggctgacaattcatcaactttgtccctgccatatttttctcaaagcgtcaagtgtatggaattataagacaatttaaaggggattttgggttgcttgtgttgttttgaatattttataacatgcagaaaacaaaacacaacaaacactatgtgatccagaaatatgatatatcattattattatctggcaaaatagttttgcatgaacattaaggcaatacacttggtccacgatgatgcgttaccaactctctgcataaaagtggatgcagaatgtcctcatagggtgtaaattgactcatccacttttcagtgaaattataatgcacctctagttttgttcagtggacgatgtgtggatgaaaaatataattaagtgataagggaaactgggccaatgctattttctcaaagcttcttttgaaaggtggtatgcatattcttgtaggccactgcactggtattgctatgctacagcgcatttctttcaaaagtaaatggcaagcaaccgaccatataattttaaaatatttcttatggttacaaccttatttcctttatcgtatttgcaggcctctcacatattgaaacaacttgatcctgagctatttagccggtttgcttcaaggccggagctaattttcctgtcgtgtttgccggtcactcctaacttccatcgcgtggcggagttgccctatgggttttcagatggccctcgcctagcttatgtaagtgctagacctctctggtgaacttcataccaaagattattttctgtatcatcccttcaacgttttctaacaattttccccttaaatgcttttgttaaatgcaaccaaatcctctgtatggtgtaaggacttacatctgatagtgagtcaacaataaatcatgtaatcaacgagagaacctaggctagtcttcctacatctaattaaatgattcatcattactctgtctaatatactcttacacaattctgttgccaaagcaaggcagtattctctctggtttccttataggtttgttgagcatgcttgttttattgtggtctgatgcacatacttggtgcattttctgggctgtgttggtgtcgtaattatggacttatatgttttttcattccatgtttggacttaggatgacctgacaaaagcttacaagaggacggttgatgtcggtaggaaacttgatgacttgcgtcagcatccacagttcagtgttcttgcaagttcacttgtcacaagccgagttgtggagtgcctcaaattgtcaaaggcaagggagctgatatcttgttttattgcagtatcgatgttgcatgattatatgtctttctattgcaatatccgcatagcatgatccacattatccagatttgaatttccctatttttgtcagttttactaaaattatacactgtcagagcctcccttgcagttttccggtcaagttctcctgttgtattgtcagatctgtagatactcaacaaaaaaaaattaaaccaaagtctgtacttcataacctcaaccccacacacacttgtgcgcgcaacacttctctgtcgtaatccagtaaaaggacatgttagcttattttgatgcggctcttaaaaagcatcataacagtccttttaatatggttagattaggtgtattttatttgaagcagctcttgtttattttgttcccactcacacatatggagttatgcatttgacagtattatatctggttcccatttttgtccatcccttttccattaattgctttccatctccaaacatgcactcagtagttgacttgcaccatatgatattcaaattgttctggcactttacctgattgtagtggagaatagcgcatacaccaatcttccaccttgatatgttgccctctgtaaacagattaaacacaaccgacaaaacatagctgtttcatctagtcccctccaagtttaattcggttaatttcgaaggatgagtatcgggttcagtgaaagaaaagctgtttgtttttgttattattcaaaacaaagaattaccaatatgtagtttgaggtggcattgtgattattgcttatgtcatatgctttcacttgcttgataacatttttatttatttgcagttacactctaaaaagacagataaggagtcatcaacagacacacatggaatgaaatggttgaaggatgccattctcagcaaacggtccgataatgcttttcggggtactatggtcggtgatccgaagattagattgcatgaaattggcatccctgtggatttagcttcgaacttgttagtttctgagcatgtgaactcctacaactttgacagcataaattcgaagtgcaactgttaccttcttgccaatgaaaaactagtcattaagcgcagtggaaagacaattattgttcggaagccaaatcagctggtaattggtgacactgtgcacaggctgttgcaggatggtgaccttattcttatcaataggccaccgtcaatacatcaacactccgttattggactctctgcaaaattactcccagttcagtcggtactttcaatcaacccactctgttgtgcaccactcgcgggagattttgatggggactgtttgcatggatatgtcccacagtccatacagtcaagagttgagcttgaggagctagttagtttgagccaccaactattgaacgcgcaagatgggcgaagtttggtgtcattaacacatgactctctagctgcagcatatctgttaacaagctcagaggttttactaaagaaaactgaagttcagcaatttcaaatgttattatgccatccactctcgccgacaccagggccagcaataatgaaatctatacactctcatggtccactgtggaccggtaagcagttgttcagcatgctgcttccgtctgatatgagtttcagcattgagcctaaggtacacatcatagacggtgaagttcttgcctgcccatctgaatctttttggctgcagaatagcatatctggccttttttccgtcatgttcaaacaatatggcgacaaggctcttgagttactctcttctgctcaggatgtactatgtgagtttttaaccatgagaggtttaagtgtcagtctttcggatatctatctgttcccagaccatgactcgaggagaaaactagctgatggagttaatctggcattggatgatgctgaagaggcttttcgtattaaacagatattgctaagtccagattccatatcgattctgaaatgttatgacgactgtgctgatttatcacaatcttatgaacagtccaatttcattcagagcaatctgccaattataaaatcttcaatcatggcgtttaagagtgtattcagtgatcttcagaagatggttcaacagcacacagccaaaaataattcaatgatgatgatgactaatgcaggaagtaagggtagcatgttgaagtttgtgcaacaaactgcatgcgtcggtcttcaacttccagcaagcagattcccctttagaattccatcggaactctcatgtgccagctggaataggcataaatctgagggcacgggtgaatgcttgggaggccaaaacttgtatgctgtgatcaggaattcctttgctggtggtttaaatccattggagtgtcttcttcattcgatatctggcagggcaaacttcttcagtgagaatgcagatgttcccgggactttaacaagaaaactaatgtatcacctgagggatttatatgttgcttatgatgggactgttagaagttcttacgggcagcagataatgcagttcacttatgatactgctgaagacatgtgcagtgatcgcaatgtggaaggtgaacttggtgcccctgttggttcatgggctgcttgttccatttcagaagctgcatatggagctttggatcacccagtgaacagcttggaggaatctcctctcatgaatttgcaggttatgctcttttactatattgtttcacggccaatgattattgtgatgtctcttttctttcttctgatactactttaacattaatttcaggatgtattgaagtgccagaagggtggtacttctatggatcatgttggtttgcttttcctgtcaaagaatctaaaaaaatatagatatggtttggagtatgcatcgctagaagttaaggatcatctcgagccagtgaacttctctgatttggttgacaccgtcatgatcctgtcagtacatttgaatcatctttttcctatcacttcacgttgaagtactttttaattaattaatattttttgcattttgttttgcagatatgggggatgtggtatagagtcaacaaaaggaagcgcatggattactcattttcatctaagccaggtcttattctttcgaagtaaccacacttcctattttataagggtcattaagctgatgtcttaaataaatatttaaacttgtacgtacatgcaggaaatgatgacgaaaaaaagattgggactaacacttgttgtggaagagcttacagaacaatacaatgccaaaagagacaagttaaacttccctaaagtttatatttcaaaggggtaagttcagaaactatttggttcccatgaaaaaaatgttcgagttaaaattagtatttatatgtctctctgtttctttttgtctaaccactaatttggtgtgccaactgcttccatgttctcgctagcgtgaaaatgaagatacagtatatgccctgttaatatactcaactctcctttctgccctcgctctcagcgtggtaatttttcgagaaaacgcaaaggaatctttgcgtttcatttcactgaaaagatgggggagagtacatgcctcctaggaggtgataattacaggatcttagcgcccaatcagtggacttcccaggaggcgtggtaattatcactaacattcatggcaacatataagttagattctgctgatgtttaccaatcaggggataaacattttggtgtgtatgctacaaagtaattgtatttcagaagcatcagtttatagtgtgtgcttcatttctttgtcgaaatgatgtcatgaagggtaaataccgctgggaagatggtcaggcggctgtttgggagagggattagattagggattgcgaggatgaggtagcgacagataggtcgtaattcttcttgcttgatcattcatctcaaggtctcaaggggtcaagtaacaacccaagctaggcaacaaactgaacatcttttccctagttggtgtaaggcttgacttaagggatatcttctccttagttgattactaattcctagttaataatactattcccaaacttaaagataacacaattatatcccttagttggagccagctagggccgtccgtacctagcatttgggtgaccaacccacacgacagtgtcaacctagcaaccttttttctctccaaatactagattttaatctattcatcatatagtattggtcttttctggaacacctagtttgcgtcatttcgttaaggaaaacaatagctgttcatggtagcaattgaactattcaagatacaatgctgttatccattgatggattacctcacatcaatgttagaccaaaccagcaacaataaatgagttatcattcttattttggagaatttgacatcttgatatagttaaaattaccacaacaaaatactacctctgtaccaaaatataagacttttttgtagactaaactagcctacaaaaacgtcttatattttgatacggaaggagtagatattttgtattagaggagcaactatatagtacaagagacttgaaatacaaggaaggaaatctagactaatacagacacatagactaatactaatactactaaacagtttttatctaaaaatttacattgtagttaaatccaactattgcattgcctgcctaagtgatatatacacatcaatatttcaacaaacatgtcaggcattagatgtgaggtgaattgtaggctatgaagtgcttatgcatgttatgcattatgcgaatgcctactttactttttctctttgagcttctgcaatatatattttgacatgtaatacttctaccctgcagcaaatgttctgctgacaatgagtgcggtaacaggcagacttgttgcatcactgtggtaacacaggatgattcaaactctatgtctcaattggacactatcaagaaaagggtgattccaaacctcctggccttactagtgaaaggtaattatggttcgatagattttccgaaacatgttttctatatttgtgctaaggaactccttactttactagatcgagttgtagaacatataattttatttttctaagtttcatggtacaaaggtaaagttgttttcgctgcaacttgtatgattcagtcttctgatgttctcataaatttgaggacccgttatgtgacttctatgtttcaaataccacatgctaacttgattccttcagtacagaacatgcggattatatttgatgcacaatacttgttttcctttgcaggatttttggaatttaagaaagttgagatccagtgtcaagaggacagtgaacttgttgtgaaagttgttatgtctgaggagcattgcaagagtgttaagttttgggctactctacaaaagtcttgcatagcaattatggagttgattgactgggagcggagccggccagggagcgtatatgatattttctgctcatatggcatagactcagcgtggaaatactttgttgaagtatatattttcttctctttgttttgattttcacttctctaaatatttgggtcaaattgttttgaagcctgattgccaatgataatttcttctatagcatttgatgtttcctcattccttgtgcagtctttaagatcaaaaactgatgatattggaaggaatattcgccgcgaacacttgctggtcgtggcaaattgcctgtctgtaagtgggcagttccatggactaagcagtcaaggtttgaagcaacaacggactcgattatcaatctcatctccattttctgaagcttgtttttctgtgagtaatttaggcttcttctttactacaagattttcctttttaaagttcggtgaacaaattcttatttgatgtcatgttctgcagaggcctgcacatacttttataaatgctgcaaagcagtcttcagtggacaatctctgtggtactgtagatgcaatggcctggggcaaggagccttctactgggacatcgggtcctttcaagattatttattctgggaaggtgagtattgtaactactgtcaaatttaggcgcatgcttttttaggggcatttcattgtactcccaaaaatgaaaaaagtaaaagcaaattgaggccttcatatacaactgccctctactccactgctatagattcatgcatttagtttttgtgagcatagtgccagatatattttcccagatacctgtctgtgatcaggctgtgggatgcttgaactgcctgtctcgtgatgttgggattattttgtaaccagtgatttaatcttggccaagtgataaatggataaaaatacgctttctccttactgtactcgatgcatatacatatgtttaattcgatgctaacatttaactttttctgcaggcgcatgcacccataccaaatgagaacatctatgacttcctaaatagccctgaagttcggcaagcgccgggcgaagctttcttgaatggtagcaccatatctgtggagcaagattttcttgttgctgcagttggtatatgggacagcattattgatatgcgcacttgcttgcagaacatgctacgagagtaatgcccccatcactatccatggaattgtattgtgcatagtagttttatcccatttgaagttttatcttgattaccctcctatatgataccatgttttacttgcatgaaggtaccaattaaatgaatgtgttggggagctagataaatcacgtgtaatcgaggccctgagatttcatcccagagggcgtgaaaagattggtgctggaatagaagatataaaggtaatataaatgtgtttctgttttcctcatagcttcgtcattctacaattctactgttatgaatgtagctaactatagatgaatgtattaataggaattctattgtttcccaaaataataggattgattttcttacatctttgtctgcatctgtttttcatttggtatatgtgctaatattctcggtgctaacatgcgaatgtgctaatgagctgtccacttaatgtgaaaaaggattgtgttcatttaattccatctcaaggttgctacccttaccagctttcgtagcattgttgtgttcccaaggttgcatgaacaacaatcttttccctctgttcatattgttcaatctgacggtatctattgtgttacatccctgttttggtacctatgcttgttgtaaatatcgtagccaactattttgcagtgcattatggttactcttgaattctagcatattgttaccctgagatgatgtggtgtgtgctcctcgcagattggacatcatcctagtcacccaggaacaaggtgcttcattatggtacgggatgacggcacaactgaagacttttcttacaagaaatgtgtccagggtgccgcggattctatctcgcctgagctcggacgttatgtagagaggatactacggaacagagcagtttcgtcataatgttagcactgttgccgtttcatctagttcagttcagaccataggtagagagcatctgatgttttgtcgacaaggagctgttgaacagtaggtagagagcatctgatgttttgtcgacaaggagctgtcgaacagaagtggacgatggtcagttatcctagagaagagtgaactgctgattggcgaagatgccgtgcttcttcgccacccttctggtaggaaatgaacatgttgtcttgtagggcgatgccattcttttgttgtacaacccttcttctctttggcattagcatctggatatgttggaaggaaactccgtcgtgaaccctgtttgtatgtagaaattttggcccaaatttctgggtgctcattttatccacctttcagaaattttgctgccatggttccggcacttgttaagaggtgacggtgaggtttcttggtgcagctaaatcttggctcccgtggtttttacggtgaggtttttctccatgacgtttgttacaaggagagatgagtgatgattaatgctgggcaaaggggagaaggccagcgcggcgcaagggcaaggacaacttctagggaggcgacgagaatgagctagtacgatcggcaatgctgcctgcccttgggagcaaagggggaggcggggttccatgaggagcgcgcaaggggagccacttgtgaaggccacagcaggggaaggaggaatgaagggcagctaactaattagagatgcaaaactcgttttccggaacacaattaaaatgctaaaataataaaggccattcatcgagaagttctcaagttgaacttcctgtccctctctgaggtgacacgggggaccctagcttccctccctccggccccttctcccttgttgccgtggaggaacattgtcaggagaggcccgagcaatgccgatggcaacgggccatctcctggatgcggctctcccccggcggcggcggatttctttgcggcgaagcacgatgaagccgatggcggccctgctcggtggcggtggggcaggctccatctagtggtgctgccgcggccgccaggggctctaggtcacacgttctagatctaggtgggcttgtggggttggtctgtggttaccggtaggcatgatgatgccgagtcgcagtggctcctgggcaccgcggtggtgctagcagcaacaatgttagcccggcgtggtggtgccagccgttctggcggtggtgttggtcgagtgtgatgacacggcttcaaggacgaggtgatgtactggcaacggagtgaaccaacatgggcagggatgcaagggcgggtccatgcggatgaaagtcttgcccatctacgttggtgccaacagcgatgacgcccgtgggtgtcgttcccccttcttggaggcttcattgtggtgtgtcggcatctcgctctctctcacttggtttgttttctccaggtgaaagcttatgttcggatccagaatgacgatggcggcaccctcgacgccatccctctgtttggagcatcgtatttggagacatggcttggaggttctaagttgcgttcctatggtgcgcgctgctgttatggaccgttctca

SEQ ID NO: 971 - DNA, 3706 bp, Triticum urartu
tagcacaagaggaggcaggcatgcatggccggctagctcgctttgacccgctgcatgtttatggaaaatcaagccaactcggtggccgcgtagcgtagggtcgtccgtctcttgatgccatgtgctacttcctactgtcatggagtgcctgtggtacgctaggagtaggcgactggtcgtaccatcatcagtgcgcaatgcgcatgtaatgatttgcaaacttgctatcttgatcgccggccactgccaattctgacgatcgatcgcgcgctagctcacgcgtctcgtccacaagtagccgggtagtaggatggtggccggtgtttgtccctactacacaaaggggcatgtcctccctactcacgccgcgcgcgatctcgccgacgccgacgtcccgcagcgctgccaatacaaacggcgcgtgcgacggcgcatcatcaattggaccagggacgccgtgttccggctgcgcgtccgcgcctccgcgactcttccttgggcgatccaacggacgcaaagcgcccgtgggcatgcagaggcgggggggggagtcctgctgggtcggcgcaagcgagagttcgtacatcgtaatcgattcttaaacgtctccaatggaagcatatacctgaagcaaagcggtcgtgtcagctccgacgaacgtgcacgttgagcaacggtgtcattccagaggcatcattacgatccatacaaccaggtcatctccagacatggatgttcacaccccggaaaacctgagcaggaaggtgcggattcaccgtcagaagtcggtgcggtgcgtctgattcgtggccgagtcagcaggcagataacgatccccgttcgtggcgtactactactggcgtagcgctggccggcgaacctccgatgctaaattgtcaccgctcaattactgctttccgcatcaacaaacggaacggataacaccgacaggcgttaatcagttccgacttcctcctggggcgtgcgggtgcggacacgcgtcgcgaacggacggcgatccacgagcgagctcacaccgaaacggagcgacgttcacagctgcgcattaatggcggcatcgactctttccaggaaatcgggtactggctggatagaggtgcatatccacagccgcagttactcgtggtatcgccgagcgaaatctaaaaaaagggaaagaaaagctaacgcgacgctgggcggaggttttgcagtccaaccctcggattcgcccgcctctccgatggagccccgccttctccagcctataaattggtgcccgctccgcctccatttcatcctccctctctctcatcgtcctcctccgcgttctctcgtctccatctgcctctctttctgccaccacagagaactcttcttggagagcctgtgaatctcgagaggcattgagtccgtcttgagttgttgttagtgtcgccttggtctttcgtttttggctttcgtgccgatcaactccggtgctgttcggcggcagtcgcgatggccggcggcgcggttgtgaacaccggcggggggaaggactaccccggcaagctcaccatgttcgtgctcttcgcctgcatcgtcgccgccaccggcggcctcatcttcggatacgacataggcatctccggtacgtccggccccttttaatctactcccgtccatggcaaccgctctattttgtaatcttcatcatgattacagagaagtgacgctcgacatgctcaattttgttcgcacccatcgtttcaaactagaaagtttgtttgcatccggcatggttgttccaccgtccacctacccacatgcataattttcggcctcgtttatacacatggaaacaaatctctgatattccatttcatttctttatcccactactcgccgggttcttgaagccgccatgaatcttttcatgtatttctcacctggcattctttccaataaacaaactctaatactcctagtatttctttctctagagaagatgtgcatgcagaaactttaaagcgaaatcaccaacaaaggaaactaattaactctttgcaatggcgttcgtccaccaggtggcgtgacctcgatgaaccccttcctgatgaagttcttcccgggcgtgtaccaccaggagcaggaggcggagcggaaccagagcaaccagtactgcaagttcgacagccagctgctcaccatgttcacctcctcgctctacctcgccgcgctcgtcgcctccttcttcgccgccaccgtcacccgcgtcgccggccgcaagtggtccatgttcgccggcggggtcaccttcctcgtcggcgccgcgctcaacggcgccgccaagaacgtcctcatgctcatcctcggccgcgtcctgctcggcatcggggtcggcttcgccaaccaggtatacttctgtcgccactgtttctttgactttgtttgtgacgtttctttgactctccatttttcttttgtttttattgactctcctctatagctggaggaaaactgaaaaaaaattcagaccttgctttggagtgacttcttttttacagtttggctgatgatgttttttactgcttgcattggacagtcggtgccggtgtacctgtcggagatggcgccggcgaggctgcgggggatgctcaacatcgggttccagctgatggtcaccatcggcatcctgtgcgcgaacctgatcaactacgggacggccaagatcaagggcgggtggggctggcgcgtgagcctcgcgctggccgcggtgcccgccggaatcatcgccatcggcgcgctcttcctccccgacacccccaactccctcatcgaccgcggctacacggaggacgccaagaagatgctccggcgcgtgcgcggcacggacgacgtggaggaggagtacagcgacctggtggccgccagcgaggagtccaagctggtgagccacccgtggcgcaacatcctccagcgccgctaccggccgcagctcaccttcgcgatcgccatccccttcttccagcagctcacgggcatcaacgtgatcatgttctacgcgcccgtgctgttcaagacgctggggttcgcggacgacgcgtccctcatgtccgccgtcatcaccggcctcgtcaacgtcttcgccaccttcgtgtccatcgtgaccgtggaccggctgggccggcgcaagctgttcctgcagggcggcacccagatgctggcctgccagatcgtggtgggcagcctgatcggcgccaagttcgggttcaccggcgtggccgacatccccaaggggtacgcggcgttcgtggtgctcttcatctgcgcgtacgtggccgggttcgcgtggtcctggggcccgctggggtggctcgtccccagcgagatcttcccgctggagatcaggtcggcggggcagagcatcacggtgtcgatgaacatgctgtgcaccttcatcatcgcgcaggcgttcctccccatgctctgccgcttcaagttcatgctcttcttcttcttcggcgcgtgggtggtggtcatgaccctcttcgtcgccttcttcctgccggagaccaagaacgtgcccatcgaggagatggtgctcgtgtggaaggcgcactggtactggggccgcttcatccgcgacgaggacgtgcacgtcggcggcgccgacgtcgagatgcgctccaacggcaagctccaggctgccaagctcccgtga

SEQ ID NO: 972 - DNA, 10821 bp, Triticum urartu
gccgggtggaaggagcgcggcgaagctcgggccccctccttcttcaccgagctgcggcggcgccccgaggaggagccggcctcacggtcgtgcttccccttgcggttccagaagcccatggcgaggtggccggccggcgagctcgaggacaatggagggctagggttcggggctgtcgggtttcgaggaggccgcgggatggcgtggggcagtgtggacgacgatcgttccacgcttcccacttaaagaaggacggcaaccttccgatgtgcggatgacaggtggggccgcccgctcgtgcgcattgatgtgggcgggtgggaggtaggtggccgcctgtcacgcggccccgacgcggacgaggcgcgcgtccgtttggtgtccgccgcgacccaaacccggcgcaagtttgcgctcgaaatgagtcgacccggacacaaaacaaacaagatgggtccgggccgtcgcgcgctggccgccttgtttgtcccttttaccccaaacggatggggcccgacaggatggggtcgcgcgatggagatggccttatgccacgtcagcccgatacagttggttgaccgccttgtttgtcccttttaccccaaacggacagggcccgacaggatggagtcacgcgatggagatggccttatgccacgtcagcccgatacaattgggggcccctgccgttaacctaccgcccatgggctcgtcggtagaaagagggttagattccgaaataattttgaataagggtcaaatccggctaaacttcagcaaaaaggtcaaaacgccaaaattggccgcgagctgatggctggcgatgcccttgtcttgctttgcggcctgtgctcgcgtcgtttgcgttgcatgcatgcaggcgggtcgatgggctgcccaggctttgttaggagcagcttttgtctgcttgttcaggcatgccaatgccgtgccatggcaggtcaggtcaggtcggtctgagccgctacgtccccgctcagatcatgggccgttgtacgtaacgtacatgttggaaagatacagggccaatgctgtagagtgcgaaacggacatccaagacacgtccttgatcggaatgaatcaagtcagaaaacatcggtaaacagtaaatatgaagagccaaagaaaaaaaaaatccagcacggtgcaaatgcaggagcgctggcaacgttgggggcgcgccccgtctaggagtccatcaacgcgtgctcatgcccggtcgttgtgcagcgcgcgcgcaggagccattgggcagtcctgccgctgcagttggaatccccgtggacccttaaccggccgggtagggggagcagagcactgtaagtttggaaacctgcgaagtttatcctgatggacccatccatccaatgcatgcaccttgccggtcatccatgtccgtgcgatgccaagttgccagccaaaccaacgacaggctttcgtcatcgtcatcatcctccccgcgcgcctaccgaggaggatatcctcgcagtcgcaagcgcagagccgcaggctcccctctcccaacgtacccatggccctggcgagcgggccactcccgcgtcattagccccacccgtcagcgaccgagcgcggacagtacaggagatacaacgaccagcaggggcggattggtgatctctccgacgagacgaaacggactcctgtagcagagagcctctgtcacctgatcctgtggtccgctaaacgcgacaaagagaagcagaaaagcgaaaaagcacagcagcgtgtgtgtgtcgatcggcagatgcgcgcgcgcgccagcgccattgttcgatcgccccatgcatggagccagtagcccggtgcacgcacccacgctaaccctaggcttgactagctcaggcgtgcagtcgctggctctcgtctccaaccctgcagattccttcctcgtagcacattcacactactagtggtacacaccatttctcgcatgcacacaaaccatcttccaatttctcaccgtgttcacccacactaccactagagtctactagagtctagatctgagacgcacgcccaaccaattcgatgccccctacaggaaaggaaagctcggcgtgtgcgcgccccgtcacgagcccccgcagcggcaagttcacggtgtgcgatggctccatctcaccgaacagcacaagcaaagcagttccttccttccgccggccacacaatgaatcaatctttcccaccggacgccatgccaatgcccatgtgccatgcacattacacgcacgcacgcacgcacgcacggatcaaacaaacaaacaaaccacacgctcgtccacacagcagcgatatgatggtctccgtcaatcattgtccattctcatccgtccatccatcggtctggtccggtccacccgggtcttggcgatcgtccttgtcctcgtccacagcgtacaggagtagtagtagtagtacgaactccaccaacacacgcctatctccgcgtgccccgaggaagatacgccccaccccaacccaactcaaccaacccaaacccgtcccacgccacgcacgggccaccgccaccttctacccaacaaaacccctggctccccacaaaaccctagcaccgcacactggggccccgcctccccggccccgcccgtcagcgactgaacaggcaccagcagaaaactcccgaagctaccccgtctctctctctctctctctcctcgacgagccccgccccacagcagcggcggcagcagaggctgtcccctcggctctgacatggcagcgggggcccagcgggaaggcgacaaagcggaggaaagcgagcgcggcccctgcctagcccacccatagctctcctccggacgagcttgcccctctcccgccttccaagcagcttccggggtggggcagtggccagtggcgaagcgccacgcgtcgcggggatcatgaacgcaacggggttccgcgtttccgtttccgtgctacggcccgcccacggcgcggcccggatgccaggaacggcaaaaagcgcagagcttttaatgggaggagggggggtggggtggggcacgaaagctgtgaaggggtactacgacgggcgggtgggtaccgactaccgagacatgctgtgctagagagagagacggtgagcagagagggacaggcggacaggcctgtgcaggataagtgcggcttttgcagtctgcgttcgccgtgcgcggtgggcgtctgtgggtgccggagggcggggagaggagaggggaggagcgctccactactagcagcagtctacataagaggagggcgatcgagcggaggcgcagggtgtttgtctgtgtgagcgagcgggaagagggtggagaggggtttcggggaagcagcagagcaggtgcggcgaggctttctgcgactccggccgcgcgcatgggagaggtgagcgagcgatcgaggcctggcgtagccggcatttcttcgtcatctgcgtgtcgctgatttgtttccgcctgcgtgttcgattcgatcgatttcttcggggtatgagatgagatgattttggcctcgcggttttgggtgggcctctccgatgagctctcgcttgtgcggcggtgccacggttcgccgaccgccggagcgagagggagggagggaggtggtaagtaatggtccttcgttttcggtgccggttcggctgggttggttcgttggtttcgccgtttcggggcacgggattgggggttttctcctaccttctccgccggggttttcaaaggtttggtcccggccggtgtttccggacgatctggtcctggtttctcgcgggtctcgttgtcatgcgtctgcatgatccttcgtctgcatgatccttcatcgcgctcccccgtccatgacccaccgtttgctgtccctcaaccgagattctcttcagtttgcttcaggggatcaagtcttctgtcactccttccgaaccctttgctcctcctgcccgtgctagttttccccctggtttccgtccagtggtggtttgttttcgatccgtcctctttgcaaatgctggaagttaatttgggtaggtgttgctttggggttttttgaccctcgtcttcgatgttttttgcgtcagattatcaagcgcaaacgcgcgtgttcttcttcttcgtggtgccgtttgatgaggtcatggtatattccttccggcttggcttgtctttgctttgcttttcctttgggacgatttgatttgacgaggcatgcaggcactctctggcgccggtggagggagagaaaatgagattccacgctgccgatcataaccggaaagcttttcgtcctcggcgatcgttttggacggggagcagttccttttcccagcttcgtctcgggcgacgtgtcgctccggcccgtgatcgatcgacgccctgacatgaccagtctgcgtttctccatgattcgagcgaagcgagagcctgctagctgcgctttcctgaccgagctttggtcgagtctgcttgttcttcttgcgctccttttcccttgcgtgtcctcaaggcgatccagtttccagtttcgtgcctgcgctctgaggcctgcagactgccactccatttatgctaccttggctggctgcattgtcccatttaattttgtcatgttgttttcgatcggttttcgtcagaaattttggagcaatcttcgggtctcaaaagatttcgtggaacttttttgcggcaagtttcgtggaatttttttgcagcaagtttgacttgtcacttttgaattttgattcgatttggtttggcgcttggatggtgcagagcttgagcgaggagggtggcgggacgacggacaagatgggcaagcaggacaacgacgtctcccgcgccgtcgtggaggacgacaccgcgctcctcctcgcggcggtggacagcatcaagaaggcggcgctgggccggctgcgcaacggctccgacgccgccaggatcctcgaccaggacatgtccaacaggctcctccacctcgcctgcaggcacgacgccgccgagtgcgccaggctcctcctcgacggggagtacgggatcacgccggcctccgtcgacgccagggacccgctcacgcggacgcccctccacgtcgctgccgaggggcactccaagaggtgcatccagctgctcctctccaggaacgcccggacggacgtcaggctgctcgatggcacacgcctagtcgcgctcgaggtcgcgctcatgagcagaaggtgcgtcaatggcatggcaccaactgcgtgctactagtatttgctagtactgatgattgctcatttggtcgatgccatttgagatcaaactgacagcaatgcatctgcgtcctccctggctgctttctcttcagggttcaagttgattggtcacaggacaactcggtcgaggatcttcttgcttatctgcaacaaaaggtttgtcccatcactaaactcacacacaggtccaaacttctcttacatggttgatactagataggatcaatttctcatgccaaactgcaacttgcctggatgtgtgtgcaggatctgaacgcggtgaggcttctggcagagaagaccagggaggttggggaggtggcttacagatacgccatggaggggcgtgtcgctgcactcgcaatgctgctcctggtgactgaggaaaggatatcggcgatggtgagcgtggtgattgatggcgtcaggacaaagagatcaatctacaactctgttgtggacgaggttctgtcgattggagaggcttcagctagagaaggcaatgaaatgaggaggaaagccttgctctgtgagattcagctgcttaaccaatttggggccacagtgtggagggaccgaaaagttgacaggagaagcttgccccctctacttagggctgcaaaggtaccgattgctcttagtttcatgctacccttaaattgtcactattcccaaatttcgcaatgcactgagtattcagtgtcttttgtttgaggtctacaccggtttatttttcttttaaacgccgctagatttgcattgcacatgaaatgagttgctatgactgttatgaagtttaattgagtaatcagtgtgtgtaactgaggtctacgccttattttccgtaaagacttctagattatgcatgaagtgagtattatgattatgatctgcaccctttgtttatataatcaagaagcagctctgcattttcttatgtttggttgatggaatattgttgtaatcatgcaactgcaacttatatatggaaaaactttcaatgactgagtgttcagtgtctttactttgtggtctgcacagacttttttcccttttagacacttctggatttgcattgcacatgaaattagttgctaggactgccatgaagttaagtgagtaatcaatgtgtgtaattgaggtccaccccttattttaggaaagactcctaaagtaatacatgaaatgagttactatgattatgatcaacacactttgttttacgtattatctagaagcagctctgcattttcttatgttctggtggatgtgatattgctgtaatcgtgcaactgcaacttatatatagaaaaatttacaatgattgagtgttcagtgtctttactttgtggtctacgtagacattttcccttttaaacacttgaaattagttgctaggactgccatgaagttaagtgagtaatcaatgtgtgcaattgaggtccacatcttattttagggaagactcctaaaataatacatgaaataagttactatgattataaatctacaaactttgtttttatgtattatcgaagcagctctgcattttcttatgttcagttgatgcaatattgctgtaatcgtgcaactgcaacttatatatatagaaaaaattacaatgatcgagtgttcagtgtctttactttgtggtctacacaaactttttcccttttaaacacttctggatttgcattgcacatgaaattagttgttaggactggcatgaagtttaagtgagtaatcaatatgtgtaattgtggtccacaccttattttaggaaagactcctaatgggttactatgattatgatctacacactttgtttttatgtattatctagatgcagctctgcattttcttatgttcagttgatgcaatattgctgtaattgtgctaagcctaacaagctgcaatttataaagctgcatcttatacatatgaaaaacttgcaatgattgattccttgtgtaggccggagatatgaatgtcacaaagatgcttctgatgggggatgttgatgtcaatgaaaccgaccccgaaggaaacacagcacttcactggtgccttagtagtagctcaagcacacaggagccaaggtgcagctaaactgtaccattaaaaacacttcttgaaaattctgctccattaactgctaaacagtaagattgttgttctcgctatttccaagtgtccttaattgtcttctgtctttgtgcaggattgtgtggctcctgcagaagaatggtgccagagttttccaggggaacaaactaggtctcacaccagtgcacagcgctgcagctaagggcaattacaaggctcttcaggtagcctttgttacttccttttcaagtggttaatataataccactgtgactaattggtattttgtttctttgatctgcaagtcacttctgcttcatgcacaagattgcgttgatataccttccaagaccaaagaaaccccattattccttgcagtgaaaaatggttctttgagctgtgtacgacttcttttgcgttatggggctaaccccaaagcccagaacctacggtgagtaatatttctgaagaattcttgtattcagtgatttgatcgacttacagtgatgcgattctttggtgttgaacagaaagcaaagaccaatagacgtggcgacatcccaggacatgcggttccttctcaactccgcaaatgttgtaccaagtaagatgattttctgggatattaaatatttgactgagttcgcaaatagaacatctcttacgtaaatacaagcacttcatttgtccttttgtgtatctcatgtaaataaaagcacttcacttgcccatagttttgtgtttgattcttcaatcaaagcacatgttctgctataagatcacattcttctatgttctattgcttgatctgtttcattacactggaaggattttttttttttttgcaaataatactggagggaattttattgtttgaattacataaagattggttacatacttttggttttactgataataatgcatatcaagcactactgcattttcaactgaattttgttcctttttagtgaaccatggctcaatggaaaagaaccatgcaatgaaaaaagaaaggcacaaagagcttctggatgatgatttcgatgattgtgacaacgacgattattatgaaaggtatttcttatatctttttttttctttttttcaaaaaggggtcaggcccatatctgtacacaattacgtgaaatgtagagaaagtgctgctcatttgaagttaaaattaagatattactttgaatatccttgcagctatgttgtgccaaaggcgtcagtaggtcaccgggattttcgggttaaaagtaagggccacagtaccccgaaagaaggccccaaattatctcgggtaatctaggcatcctgtatctgtattaccaagtgacttcttttctgtttacatgatctgcttacaacatattttgtttatagcataatgatcattgggagaagcatgactacactcgcaaaatctttgttgggggtctcccgctttcagtagacgatggtatagcttcatattcctgaaccagttatgttcaacacagtgaacatgaatgtacttctaacactttctttggcatttgtttctggcagcgtaccttagcaaattcttcagtactgaattcggacctgtggaggaagcaatagtcattaccttaaaaatagacgagaggatacagtcccgaggctttggctttgtaaaattcaaaagagagaaggatatgattagtgcaaaggaagctcatcatgtctatgtgcttgggaagagagtggagataaaggatgctgttgctagaccgtccctgcctgaactcgaaagagcaacttccttcaggcaccatgtacgtgagtccccaagagtgactcatagtgagctggaggatgaacaagctgagcaatataactttggaaaacggcggccaatgccagagaagcacctcccgtcttggttcttcatattcaggaggtggttgccaggatttctcatggaagcaaccgagcgatatggggagaagtacccattatgctctgtgaagactgatttcagatcatgttgcagaatggagcttgatcattctgcccttggctatcctaagctaagcgatttcatgcgctccctccctggcatatgcaggatgcgtgtagtccctgtaggaaatggccctgcaacacatatggtccttctgccacccctctcaaggccaaagtatgtacccttgctggagccttactcgtttgatcatgacgagctcccagaatcagtgtcagatcatcactctccaagatcaccacttaccgccaatatcactgagaatgctccttatagcactgacagtccacagggtgatgcatgcagcgagaccaatgtccagagccagcatgatgatgagtgtagcagaagcaatggcgaaagcctgccggatggtgattccacctccaattgtagcttacttgatgaggttactgtgagcacaccaaagtctgatttgatcgagtcacctgcaagaaagcctgatttgatcgtgtctggagctcttcctggaaaagccgaacaaggaccgttaaggaggcctgatttggtcgagtctgcacctacaaagaaactcgatttgattgagtccagtcctcctccttctcctcctagcaaggctgatttggttcagcctgggcctgcagggaagcttcatttggttgagtccagtcctcctaggaaggctgaattggttgagccgggaccagcaaggaagattgatttgaatcaacccagaccaacaacacgctttgttgatcgtcctgttgaaaggccagcaatcactccaagcagctgcgagaatgaaatgagattctccttcttccactcacagtgggacaagtacctagtaagtgctcccttcttctcttgtgttacgttgcttgccacattagttaggctcagaatcatgtcttgattcattgactgacacacttatttcacctgtagactccacatgccaagagtgactactgcatcatatgccgctcctgtgaggccgcgatggagcttgtcccgtgcctccataagatatgtgttgcctgcatgatgaggtgcaatgtcagggcatgcatgacctgtggcactgctgtaagtggagtcaagtctgccccggcgctggacgcaaaatcccgacacgtggtaacaaattttctcagcagctaaaatttgctctgctgttctactttcactacagctgcattcaattttgcctgatgattaattgctgaacacgcagggagtcatggagtgcgtctcggatcaaaagtgccagttgatggttgtctgcagtggagctgatgcagttgtgagatgctccccctgcatgcacaccatagcttgccgaggctgcctcctggcctcggtgacactgctcaagaagtgcactgtctgtgactgcatgattgagcacttcaagtttggtccataa

SEQ ID NO: 973 - DNA, 10006 bp, Triticum urartu
caggagacgaaggggacacgatgtttacacaggttcgagccctcttaatggaggtaaaaccctacttcctgcttgattgactttgatgagtataggggttacaagagttgatctacctcgagatcgtaatggctaaaccctagctgtctagcctatatgaattttgattgtctctacgaactaaaccctctggttcatatagacaccggaggggcctaggttgtacagagtcggtttatagaagaaggaatctatacatccggacgccaatcttgccatccacgcaaaggagtctcatccggacacgggggaaggccttctactttgtatcttcatgacccatcagtccggcccacaacacacgagccgaacacccgaggaccccttaatccaggactccctcagtcaccgagctgaataccttggcgatgccgagatgctcatttggtccttcttgaccgcacccaacgccttctatatcgacatggttgtagttctcacgaggcatgcatcagtcaagaaacaataagatgattgatgaattcccgaggcgaagaggacgacacagttttaggagcaacagtggcccaatggagggggagggggttgaagaggatttgattaggtagctatctgattactagatgattacggaaatactatttgagtaggtaaaaatttgattagcgatatttccataaatacacgcggtaagctaaggaaaagcgggatcgaggggatcgaaactcctatcgatcgatgcggggaggaaacgaacgaacgaaacgagcgaatgacctacgtaccgagactttaggtatagagatgacggagaaccagggcccgcagtaccgctaagggagacgcggagaacgagagctcgccgcccgcccagaagaaaattttgaactatgattgaatctatgtcgtacaggagaaagttttgtacatggaaagtctcgattattgtttttctgttgtatggttgattggtgctgtatatggaaagtcttaattgtttggtcaggagaaagttttgtatggaaaatatatgaaaagtcttggtcaatgatgtatctagaaagtcttgattgtacgattgattatttcttttatatggaaagtatcgattgattgtctgattggttcgcgctgaaaaaatggatggggcaggctggcctttgatggggtatgaagcgacaagacaacctaccaactactccctccattcaaaattacttgtcaccggaatggataaaagtggatgtatttaaaactaaaatatgtctaaatacatttatttctttgataaatatttctggacgaaaagaatactcattaaaaataaagattaagagtagtagagatttagactcctaaaaaagagtaatatatattctgagaccaagggagacactcagacacataaacctgctcggagtacagaaacccccaagagcccgccggaacaccaaacccttctgtccccactacattccgatggcgacggcggtgtcagcgcccgtcttcacggcgacggtgcgggtttccaatatcccgccctccgccgtcgctaaggagctcctagcattcttcgattccgccgtcgccgctgccggcgaagcctacgcctgcgagatcgccgccgcccgacgcggctggtgaagtcgaggcgatgggagcggtcagttcgattccaccgccaccgcaaccctcgccgctgaactcgcctcctcctgtcggctaccccgcttcctcggctccctcctctccgtctcccctgcctccgtggaccttctcccccgcgcgcccgacctttctctccgcgtggccgacgcccgcctccttgtcggcaaccgcgtcgccgagcgcgaattcgaggcggccgacacttgggacagcgtccgcgtggaggtcatcccggggaagcggcgcatagacctgtacctcaatcacgattcccagaggtacaggcttgaggtgtacttcgaggacatcaggaactgtctccagtgcagcttcgatggggccggcgtcatcttgcttcaggtgagctgttcacggtgtttatttatttttgaacgttgcagactgtaggagaggctcctacagtcatatatattaatcaaaaaagtactttacatagtgtacaagggtgtggtggggcttttgccccaatcacagtgtactagggttcagaggtataagtaattacaggggattaaagtagtttggctaaccctaggcaatctctctggcaaattcagtaatgaaccctagcagctcaggttttgtcctgtgttgcaacatcaagaaatcttctctgaatcttgacaaccaggacctgtcggaaggcgtcactcctctgaagatcaggttattcctctccgtccagatcgaccacgctgctgtggtgaacacttccatgatcacgggtttgtttagcctctgccatccagtcaaacctatctccttctgttgcccaggtcaacccaactgaagtccagcacgtgtaggagaaactgcaggtatagagcagatgttccagagtttcttcttgttgggtttggcagagcacacagtagtccgtcctgtctgtcgatgagcccattacttaatgtctacgtttgagcatgttcttggtgttttaatctgtcggacaagaggagccacacaaaaacccttagcttcattgtacacctcgacttccaaatccaccgaaaagcctgattagccatgacattttcaaaggagaacttgtaatatctggacgatgaatatttgggccccccatgtgtatgcccaaacatctctcagctctaggtctatctgacactcagcggtctccatgggcagccccaggtacgtgaacggcatcgagcctactgtacatccaaagatcgcagcaaagcctgccgccgacgccatgtctaggttgatcggcaccagagtagtcttctcgaagtttatccaaagtccaaccgagtcagcgtaatcaagcagaattttcttcacgcctcttgctgttcttcatatgcctgcatcacaattatcgtgtcgtccgcgtattgtattgcgggaagtctttgtgtgtgcgtggggggattgggtgtctgaggacccctcggcgaagtgcatcgttgacagcagcttgcagcaggtcggccgtgaggacgaagatcaagggcgatagcgggtcaccttgtcgccccgcccccggcggcggcatcgaaactgatggcccggaaccccattgagcagtgggaaaagtccatgtgtctcatgacctcaatcatagccgggtgttctatagtatcgaaggcctgggaaaagtccagtttcagaataaacgcgatccagaggcttgacattggtatatatactcgaatgcccaagccaagcaggtcctgtatcgttctccctttcaaaaatccgtattggttcctgtgaatgatttttagaatccatttctgtaaccgatccgcaagcagtttgtttattagcttcagacaacagtttagcagtgtgatggggcgaaaatcttttgctctctggggcgagtggatcttcagaatgagaatgatgaacccggtgtttatgctttcaagattgagttcttctgtgtggaaatcatgacaaagctgataaaagtctggtttgattatatgctagcatgatttggtaaagtaaccactaaatccatccggccctgaagctctgtcggccggcatggttccaaccacctcatcaatttccgcctcagtgaatgggacataaagttcttccagtccatcaatcttggtaatgatagagcctgtgtcgaatttctgatttggaggcgaagattcccccaatctttctttaaacacattgagcagtatcccttcgttgcctgtgtggttctcaacttcagtgccatcgggtaatttcagcatggcgatgaagttatttcggtatcgctctgtggccatccggtggaaattttcgtagtttcctctccaaaacgaataaccctgacagtgcatctttttctccagtgttggttctgaatgttcagaggctgcagcaggtgagtttttagaattcgcccgaagttcgattctggggttgtgagtgttctcaggttttcaatttcatccagctcgttaacggcccattcagtgttttggatcagcactttgagacgtgagaggcctttactccactttttaagggtgtaccttagtcttctcattttctggcaaatcctggctgcactattatgcaaataacttggtttggaccaagaagtattcaccacatcaaagaagcctctgtgctgcacccagtaagattctaacctgaaaattttgctcgcggggatcgatgatcctatactgaccaaacaaggcatgtggtccgggattggtttggccatggcagtaaccttggtattaggatatactgaactccaattgttagacgtgaagaaccagtcgagttggtcaccatgttgctgtgatacttctgtttttcctttgtacattatatattagtcagacgttgcggtcatagggcgaagtagaaatttgaagaaggaagctctagatgtacttccctccctcaatacttgcgcgagctgaaaaattggcaagttctcgattcagtaaactagagtgaaccatgtaagatggatagtggtgcgacttttatttccgctcctataaatatctcagttggtggttactaattggagtgaaatgaatatgaagcttatctgatgaatacacatcaccgttacttttctaaatttactgattgccatacttcttagactataagtttgtgaggcgcaacactcttttaattctttctataattctgaagttggtaaaatatatattatcttgactaatgttaatttactatttgtttcagctcatgtatgcaccaaggatatgcacaacaatttctgggcctgcagtttattcaaggttctcagatgaccgctttcatgcatgcaaggaggatgcaaaatttacctgggtcagagcactagattttacacgcaaccactcttttgggaagtgttcaactcttgccctcgtacttgatgaaggtgcaccggtgtcatttattctcaacagcttgcctatgtcaggagaattaggggaattggtcatttcttcaatggaattttttggcccgtcgtccaaagtcgttccccttgttgactgcccaagtggttgttcagtgtcatatgaagttctttttcgtctcaattctcttgttcacatggggaagatagtttccaaggatgttaatgccgatctgtttaaagctcttgaagaaataccagttcatatttcaaggaggatttttgagaaaatgaacaagttagactttacatgctatgaacctttgcaattcatccagcaggaggctcatagcaggaagaggagccatgatggtttgctttccagtaagactgaaggtgaaggaaagttaatgatgtgttacagaattcacatcactccatccaaaatatactgcttgggacctgaggaagaggtttcaaattatgtggttaagcatcacaaacagtatgcttctgactttgctagagttacttttgtagacgaagactggagtaagctttttccagatgctatctcagctagaactggacgagggttcttttctcaccccttgaaaactggcctatatcatcgtattttatccatcttgaaagaaggattttccattggtccaaagaagtatgaattcctggccttctcagcaagtcaacttcgtggaagttctgtttggatgtttgcctctaatgattccctgaaggccgaggatataagcaggtggatgggcaactttgaagatattcgttcagtatctaagtgtgcggctagaatgggccaactgttcagctcctccagacaaacacttgaaatcctaccacgggacgtagaagagattccagatatcgaagtcataactgatggcagtaaatatatattttctgatggtatcgggaagatctctgagagacttgctaaagaaatggcttgccgaattggattagactataccaaccctccttcagcttttcaaataaggtatggtggctacaaaggagttgttgctgtggaccctgattcctttcgtaatctttctctgcgacctagtatgaagaaattcgaatcaaagagcagaatgtttaacattacaagtaccagcaaatcccaaccatgctatatgaatcgtgaagttatctctctcctttcaactttggggataagagatgagatatttgagtcgatgcaacagaatgatatgcgtgaattagatgaaatgctgaccaacagagaagctgctctctctgttctggggaaaattggtagtgcagaaacaaagacagcatcgaaaattttactgcaaggctatgaaccaagtttagagccttacctgttgatgattcttaaggcccatcaggataataggctgactgacataagaactagatgtaagattcatgttccaaaaggccgtgttcttattggttgtttggatgaaacaggtgaattagaatacggtcaagtgtacatcagaattacaaagaacagcaaagagcagaaggataattgtcagccatattttgctgaagataatggaaaagagaaaacagcagttgttgttggaaaagttgcagtatcaaaaaatccttgtctccatcctggtgacatcagagtacttgaagctgtctatgaccatggtttgtacgctaagaacctggttgattgtgttgtcttcccccaaagaggagaaaggtaatgtcgtatgttatactgaaactgaaagacgatcatctagagtttatattgctctggcaatgccttcagaggagctcaaatctctattgaagtgtttgtcagcgtgttcgtttccatgttagattgatatcccctcatgttacgtacttacatctctacctattgatggacgttgccaatgcttgctttctccttcaattaatctttgatgtttaataggccttgtttatgtagaatttaatctttgatgttaatcaggcctcatccaaatgaatgctccgggggcgatttggacggtgacctctattttatcacttgggatgagaaactgattccagagaaggttgattcacctatggactacactgcagcaaggccacgcataatggatcatgttgttacacttgaggtatattcctcgctgtttattcattttaatttctcttactaggttgttgctgctaatttaccgaagattgttttatttgactaatatcaatttttatacttgcaattgcaaatataatgaaaatctcagttttttacaatctgtagcatttcgataatactagaagaaaatgtgcacttcgccgcaccgttttccattgttataaatcatcaaagaaggaattctttaaacaaaacttctgatgcaaacaaatcacaggctaaaatcattcattttgaacaactttttattgcttgcctatgggttcatgggttcccagagaatctggcaagatatattagctaggttttgaagttgacaaaacgggaaggaaaaactgcagtgtaggatctactctctctgtaaagaaatataagagcgtttagatcactaaagtagtgatctaaacactcttatatttcttcacatcttttattttctctctttctttccatgtttgtctctttcttgtccctgtggtctagttttttgactgctctataactcttttaggtccgacgaaaagttattttcttaaaccacaacatgaccacatgacaaatccaggatgttatcaataagcaataatgccagactgagctgtgcactttccaaatttggtgaaaagtgcattctatcttccaattctttgtagcctgacaaacattctaagtggtcactgctgaaaattttgtgataatattagcctattttgagcttgcgtaactgaacacatcaagaacctgacggcgtgattgtacacaaaatggcacacaagcattctatactgcacccatgtcaggtttaattaagtttacagctcgtttactaatttaattagagtggacaaataaggcaagtaacctgaaaattccaacactaagtctgtccgaccactcctttcctgcctttctgttttctctatccctgtgtgctaagtgcctcaggccgatttcgccgcaccatgtgagcccgagctagagtccatcttccactgattacccccaataaatcgaacgaccaaaggcccatcggccgctacatgaagacgtgccaacaacccttgatggattgaatggaactatatgtaactccattaagagctatagcaaaccatcagattaaggatgggaacttcaccttcagggatgaacacctgatgtcaatgcgaatgaggtaaccacagtactaagtggttcctttggttgtcgatgtggtggctggttggagcagcacctcccctcaaagcccccgcccccctccaaagcagcaatccagggcaccttagtcaaaggcagtttagattgtgtcaacgccagctgaccagtgggaccaaaatgataaaaagccagatcgctgagggcggtatatttcgggggagcttagtaactttagagatttattatcttgaggcaccttacatctttctaaaacatttctttcgcaaaaactgggtgcatgcctacagccagagtgaactggctacgagcgtcgaactcagccaggatggaataacagcacaaaattttgaatgctttggaccaaatatatgctcgccatgcacagttttttcttttttgattttttcgccatgcacagttaataacgttctttagaaatgtgggtacttatttcggaaagaaagacatttttgccatcctctaatgaaaacagttgtgcatgattgagttttaaagtggtgttggctttaaaatgctcttcaatgtatatatctaaccttgatagcttcacaactactccctctgttcctaaatacatgacgatttggccattcaaatgaactgccaaaacgtcatatatttaggaacagagggagtatttaccagttagctccaataagcagttcaaagttgtcttttcaacaagcacatgtattttccttgcctgacatgtttatacctgtaatcttataagaacacctgatgaactgcaggaaattcagaagtactttgtggattacatgataaatgactcgctcggtgcaatctcaactgctcacttggtccacgcggatcgtcatccaatgaaagcccggagccctgagtgcctccagctagctgctttgcattcgatggcggtcgactttgccaagacaggagctccagctgaaatgccccggtcactgagagcaaaggagtaccccgacttcatggaacggtgggacaaaccaacgtacatctccaacggcgctctcggcaagctctaccgagcggctgcgagccgtatgcagagcgctcctgccccctcgtcctcggctcaatctagccccgcgttcgatcctgacctagaggtccctggcttggaggaattcctggcatccgcggaggagttctacgacctgtacgcggagaagctgagcaccctgatgagctactatggtgcggagcatgaggacgagatcctgacgggcaacatccggaataggctcctgtacctgaagaaggacaacaagaggtacttcgagatgaaggaccgcatcatcgactcggtggagggcctgcacaaggaggtgcagggttggttcaggagccgcccaaaggcagaggcgtcaaggtgggcgtcggcgtggtaccgcgtgacttatcacccggagcaccgacggccgggaaagaagcagttctggagcttcccgtggattgtctgcgacgagctgctgaagatcaaggagtccagtatgcggcgcaggcagcaggtggacgacgcggcggcctga

SEQ ID NO: 974 - DNA, 1564 bp, Triticum aestivum
aatacaaattaaaagaaaacaggtatataatctgttgactaggtgtagttggtgatcagttgaatgttcacgaatgtattccattgcatttctaattgcaacaacaacaacaacaacagcaacaacaacaacgaagcttttagtcgcaaacaagttggggtaggcacataagatcccgcaaccaactcatagttctggcacatggatttctgaaatgcatatatttaaaataattattcaagatttccacgatgatgttttattgcattctgatttcactcttcattgatgctcactagtggttaggcatgggcaaccaagaacttcttgagtatttcagtgattatgctgcgaccaaagcacgccatgcatatggtccaggtgggcaccgtggcatgagtgtgctaatatttgaaagctctgctgtgggctatatggaggcagaacgtcttcataagcattttattgatcaaagaacagacagggacacttggcagaatcgcagggttcctttcttacctggtgggaagagacaattatacggtttcctagccagaaaggaagacatggagactttcaatagacactgccaagggaaaagccgcctgaaatacgagatgagatctcataatgagatggtagtggcccagatgaagcaaatgagcgaagataatcaacaactcaattatctgaagaacaaggtggttaagacagagcagcgctctaaagttgtagaagaaaccctgggtgttattacgcagaaacttcgagagactatggaagagaatatattcgtcaggagtaaagctaaagagaagcactctgagtatgaggaagagatgaaatcccaggaaaaattcttccatgatcagatagagaacattcacaaggccacagaagacaaggaaagcgagtttgagagattgctgcaggaggagcgtgcaaaggctagacagtgtgatgtggattctgggactactgaaaatcgcaggctaaggaaggaacaggtacagcggttcatagagtgccaggttaaggacgtgcaggagtttgaggctgaaagggacgaaatgataaaagcgcacgaggagaagaaggtgcagctgaagaaagagtacatggcaaaggaggtggagctcgagaaggagtttgatgctgctctcaccggtttgatggagaaacataggccaggcaccttccaggcctccagctccagcccgtgaagattcacaactatctgagatttgccttctgcataacgacatctaaagatgcaagaccatatgtggtgcatgattaggaatcctgaacttgattgaacctgtatgggtggttatatggccatgattaggaaacctgaacttgtctgagtgtcaagtgtcagtagcatgttttacaccactatctaatgactgcctggggagcaagcgtcgaatcccttcttgaacatgttaactgtaatgtcatcttgttgtgctttatgtcgaacttcggtctggcgggcggcattgattgagtgaaaatatagacaagtaatttgggatggaaaaaaaaaaaaaaaaaa

SEQ ID NO: 975 - DNA, 6167 bp, Triticum urartu
ggtgtcgagcaagtcggtggccccaccgggtcgtccgggtttcggtacggaggggcggaagatgatcgtgcgagcgaaccacttcctcgtcggcttcgcggacaaggacatctgccactacgatgtgagcaaccctacctctcttcgtccagaagttcttcctctaccatagattgcatgctggctagtggttctgttacatttgttttgatgcgatctggccctggttgcgattgcgacttccatacgtgattatgcgcgagccctggatttttagtctcgcgtcttttcggttaatttggaaagatctcgtatcgatcttttgcttgatggttgtttccatagataagtttcattgctgataaacacgatgtcaggggctaggatatgatgactacgtggtcaaatttattttgcatcgaagacgcgcagatctagtgcgtatgcgtggtttctcgatatgttcagccggagattattttcctttagttttttctttatgggttacacacatttgctttgtgctgttaggcatttgtgctttggggccgcgtaacatcttttgaaggccggccggatgctaggccttggcgtgctagctttgcaacagtgcgatgtacatttagtcgcagcttccaattggtttccagaggcccttttttccgcccggtttccgttggtttctcttttcctttgaggtttttactttttactcgctgccatttctagcaaaagttctgcagcacatgtggtgtgcttgctccattctggtttctggaggaggacgtcgtcccgaatggcttgtctgcccttgctgtcaccacagctggtttctttctgaaaaactgaggcgcagacgagataacgcgcttgtctgcccttgctgatttaggcaaaaaggccttggcccctagcttgttggttcataggcgtaatagctgcagactttgccttgtgccgtgtggggtccggtcttgattattccctttgttttgaccaaggctagctaatgttagtgtctataacattatagaatgctactacaagcttctctttcacatgatgctaattaatctgcctattttcattcaatcggatgatctcactgtcaggttgcaattactcctgagcccaagacaagacggatcaacagggttctaatgacggagctgacaagcaagcaccgcgtgtcgtctctcggtggcctactggtcgcatacgatggcagcaagagcctgtacactgcaggcgagctgccattccaggcgatggatttctccatcaagctggggaaaccaccaagagaaacgtaagcatgtcttaactttcctgtctcgtgtgcgttctaggcctacttgtatctcaagtgcagctgctaattcacacttttctgctctgccttttttttatcttctacatttgaaaaaaaaaaagtgagtacaaggtcacgattcggttcgccgcgcgggcaaacttgtaccacctgcagcagttcctcagtgggaagcaacgtgattctccacaggacacaatacaagcgctcgacgttgtgttgagagagtcaccttctctgaagtatgatatcattgttaacgtctcttctctgttatgtttttactgctgactttgtttaatgtgatcaccatatatatatggatcttgttgttctacagctatgtcaccgtttctcgatccttctactccacaatatttggccaacgtgacatcggtgatgggctggagtgctggagaggatattaccaaagcttgcgccccactcagatgggcctctcactgaatataggtgcatattagttcaaaacccctctcttaattcatggttacaaaatcacgtaggccacactgcaattatatttttggtatagcacgagctcttgcccaagtggatatcacatttattgtgtttagttctgcataaagctactacccaacccatgtctgtctgtattatgtcacttgtttacctgggttatccaaatttgcaaagactaaggggagtgatttaaacacaagtcgactactgaacagaagcatatatagcttgtggtgaggttcagggagagaaaacttgcagcacatgagttcaattaggaaaagtgtatgcatgtgtgtgtgatttaaacacaagtcaactgctgaacaaatttgatgttattacagtgtagttttaaggtgaacacagattcatttgagacgttcttttccacagggttatcacttttatgaacccttgttgtacttgttgtgcagatatatcatcaacgccattttacaaacctatatcggtgatgcaatttgttcaggagtgtctgaatctgaggaatcccgaccccaatcgccccctttctgacagggaccgtctgaaggtactgcatttatcaaccaagaacgtatcatacacaaatgtttatcactactagccgaattgtttcgttctttccagcttaggaaagcattgcgcgggattcgtgttgaaaccactcatcaagagggcaaaaggagtgcctacaagataactgggattacttctgttccgctgattcagctcaagtacattgttcctcctcttcttccatctcctctccttccctccttcccttctagtgccaaatgatttactggtgtttgttgttttagctttcctctggatgaaggcaaccaaatgactgttgtgcaatacttttggggccgatacaagtatagattgaggttcacttcttggccttgtctgcagtctggaaatgattctcgccctatatatttgccaatggaggtaattttttcttatttgtgcataacaccaaatgtggaagtctgctaatgatatataatatgattgtaggtatgcaaaattattgaagggcagaggttcaccaggaagcttaacgagaaacaagtgactggcatactgagagctacgtgcgaacgcccccgtgatagggagaacagcatacttaaggtatttgtccagacaataggttttaacacaaccaaactaattgattgaaattacttgaaagtgcttattacatcatttttttccatgtgatcatgttcgttatatttgcctcattagcattttttaatgaatatgtattctatagatggtggagcacaacaactattcagctgataagctggcgcaggagtttggaattgatgttacagataaaatggtcaatgtgcaggctcgcgtgctacctccccccatggtgtctattctatttagttctcattttgatattttaccccctgtttttgttagttaatttcaactgtttatgctgttttagctcaaatatcatgaatctggaaaggacaaagcttgtgcaccaagtgttggccagtggaacatgattggcaaggtgattcatttctgacttggaacaaaaaaattctgttacctgctcatttttaataatgccacaagactataacaatcttgtcacaactgtgaattgtggtcgtagtcttttagtataacatggacgcacaaacagaaaattcttggattatgtattattttttttcagtctagagaatttaaatagaaacttggttggaagtgtgagctacacaatttgggggcttattccttctatccatgaaagttaaccagttctccctaggtaatctagtttatgtttttttaaacatgtccctctttctgatgtatgatttctgtttgtattttagaaaatgataaatggagggaatgttcagagatggacttgcttgaacttttcacgtttgcacattgatggagtcaaaaggttttgtggcgacttagtcaaaatgtgcaacgccatcgggatggtatgttcagcgcatatttgtacatacaagtcgcccatatcatcattcacgtcacactcaatttattttcaatctttaggttttcaatcctatgccagtggtagaaattctctcagcgtccgccaataacatagaaggtgctttgaaggatgctcaccagagtgcccgtgacctccagttgcttattgtgattcttccggatgttactggccattacggtatgcagtttttttgtgaaacgatgttatggtatgcacattctttttttacctagtttaggcgatgcacatttcctaagttatggcacgcacatctttagtatcgccctttatctcttgctgttaccttgtctcatggtacccatatatctgtgcaactctgcagggaaagttaagaaggtgtgcgagactgaccttggtatagtatctcaatgtctcaagccagacaaggtcgaaagagcaaacaagcagtattttgaaaatgttgcacttaaagtcaatgtcaaggtgggtttgttggcagtcacctttttctgttgtgcttaggtgttcaatggagagttatattgtgttttcttaattattaggtcggagggagaaatacagctcttcagcaagctcttacacgtcaaataccgttagtcaccgatcaaccgacgatcttttttggtgctgatgtaacacatccggcggcaggggatgattcctcaccgtcaattgcagccgtgagttccgttcatcttctgacagcaattgttcacttgataatttggttaatagtgtgtgaatttaaatgagcttccattgtattatctggatgtcattgtgctgatgcagttggcatgcttttgatgagtgcctgcaggtggtggcctccatggactggcctgaaatcacaaagtacaaagctgtggtttctgcccaaccgcccaggcaggagattattcaagatctctattgcacaggcatagaccctgagaagggcacccctgtacacagtggaatgatgcggtaagtcctttgtgttaattcagagtagtggatggcggtgggttctaaatccgcaacattttctgcagggagttgctagtgtcattctttcagaagaccaaacataaacccagcaggatcatattctacaggtaagtgcttccaacctccaattatgatgttattgttcattgtcagcggcgccttttgctgaatcgttttgttttctatgtagggacggtgtgagtgaagggcagttcgcccaagttctgatgtatgaaatggatgccatcaggaaggtgatgcctttaattcatcatgttctttgcctgtctaattctgctttaatcctattttggtgtattaacagtgttccttttttatggccaaaggcttgtgcatctttgcaggaggattatcagccccctgtgacatttgtggttgtccagaaaaggcatcacacaaggctcttccctgaggtgcacggaaaagagaccgacaaaagtggaaacatccttcctggtaagtgtgcctcacacacacattaacacatgcgtttaatagcatctgcgtttgccattgtgtttgattgtccccattctctcgatgatgcttccaggaaccgtggtcgacaccaacatatgccatcccaccgagtttgatttctacctgtgtagccatgccgggattcaggtacggtggcacccattcctttcactgccggttgggacatacactttgtgttgcattgactgactgtgagcattttgcatgtttttttcagggcacaagcagaccaactcactaccatgtcctcttcgatgaaaaccgtttcactgccgatgggctgcagctgctcaccaacaacctgtgctacacgtaagctcgacacatctccctctttcacttctttttttctgattcaggttaatctaccatcttgactcctattttgctagctagactaactccgatgtggtatctttgcctgtaaatgcagatacgctcgatgtactcgctctgtctctgttggtgagtttcttctccaagttcatctcacatttttcttgtaaaaaagagaactgcggtatgcaattatcttctgtggtactaatgctcgagtcctttcttcgcagttcctcctgcctactacgctcacctggctgcgttccgcgcacggtattacgacgagccatcggagggctcggacagcgcctcgatcgtcagcggtggcacccgggagtcagctgccaccggcgcaggagctgctggtcctcctgggacataccgtcgcctccccaggatcagggataacgtcaaggacgtgatgttctattgttg

SEQ ID NO: 976 - DNA, 3157 bp, Triticum aestivum
gaaaactgtccaggggagtgttgttcgaggagaggagaggggagggggagagacgagaaggggaacggaaaagaaagccaagccctctcttgcggaggccaacggcaaggcttcctcccttgcgccctcgatcagttcagcggttcggctcctcgggaccattgttggttcgccgaaatggagtcacacagtgatgacttgccaccaccaccaccactcccgccaaatgcagagccgataaaagctgagtcggctgatgacttgccaccaccaccacccctgccgcctatcaaacctgaagaagcaaagaagatctcaaagcctaagagggccctgatcgctcgtcctggttttggcaagaggggaaatcctatacagcttgtgacaaatcatttcaaagtctcgttgaagacgacagatgaattcttccatcattactatgtaaatctgaagtatgaagatgacaggcctgttgatggaaaaggtgttggtagaaaagtcattgataagcttgctcagacttatccatcggagctagcccataaagactttgcctatgatggtgaaaagagtctttttaccattggtgccctcccacaaattaacaatgagtttgttgtggttcttgaagacgtttccagtggaaagactcctgcaaatggcagccctggaaacgacagtccagacaagaagagagtgaaaaggccatatcagactaaaaccttcaaggtggagctgagttttgcagctagaatccccatgagtgctattgcaatggcactcaaaggccaggaatcagagcacacgcaagaagccgttcgggttattgatatcatattaagacaacactcttccaaacagggctgcctgttagtccgccagtcactttttcacaacaatccttcaaactttgtggacttgggtgggggtgtgatgggctgccgaggtttccactcaagctttcgagccacacagagcgggctttctcttaatattgatgtttctacaacaatgattgtgaaacctggccctgttgttgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacagatgttttccctcaagcaaaggaatggtgggaatggtgaccctgaagcaatagaaatatctgtttatgattactttgtgaagaaccgtggcattgagctgaggtactctggtgatttcccttgtataaatgttgggaaacctaggcggccaacatatttccccattgagctctgccagctggtgcctttgcaaaggtataccaaatctttgagtaccctacaaagaccatctcttgttgagaagtccaggcagaagcctcaagagaggatgtcagttttgtctgatgtactgaaacgcagcagctatgatacagaacccatgctgaaggcatgtggaatttcgatagctcagggctttacacaggtggctggtagggtactgcaggcccccaagctcaaagctggaaatggtgaagatattttcacaaggaatggacgttggaatttcaacaacaagaggcttgctagagcttgtgtggtggacagatgggcagttgtaaacttttcggctaggtgtaacaccatgaaccttgtcaatgacctcatcaagtgtgggggcatgaagggcaatacagtagaaaaacctcatattgtaattgaagagaatggttcaatgagacgtgcacctgctccaaaaagggttgaggatatgtttgagcaagtgaagtctaagcttcctggggctccgaagtttctcttgtgtattcttgctgagaggaagaactcagatgtttatggtccatggaagcgaaaatgccttgctgactttgggtttgtcactcaatgtgtggccccaacaagggtcaatgaccaatatctgacaaatgttctgctgaagatcaatgcaaaacttggtggaatgaactcactacaacaaattgaaatgtccccaagtatacctcttgtatcaaaggtcccaactctcatcttgggaatggatgtgtcccatggatcccctggacagtctgatataccgtccattgcagcagttgttggttctcgggaatggcctcttgtctcgaaatatagggcttcagtgcgctcgcagtcaccaaagctcgaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgctgattgttgcccagaaaaatcaccacaccaaattcttcatacctggatctcctgacaatgtccctccaggcactgttgtagataatgcagtctgccatccaaggaattatgacttctacatgtgcgctcatgctggaatgattgggactacaaggccaacacactaccatatcctgcatgatgagatacactttgctgcggatgacctgcaggatcttgtgcactcgctctcatatgtgtaccaaaggagcacgacagccatatcagttgtttctccaatctgctatgcacatcttgcggctgctcaggtggcgcagttcataaagtttgatgagatgtctgagacgtcgtcgagccagggcggtggccacacctctgccggcagcgctccagtgcaggagctgcctcgtccccatgagaaagtccgcagcagcatgttcttctgctgagccagccagccagccgcacttgcgcgttccaacttttggtgatgcgcttggttatctagtactagtagtatgtagtagtggcctgtgatggcctgttggactcctgggatgttgtgttcctaagctggttgctgcacttggtgcctcagaacctttgaatcctgtcagggtgctgcagttgaacctttactatcgaaccatctaatttgttgctttccaaaaaaaaaaa

SEQ ID NO: 977 - DNA, 852 bp, Triticum aestivum
ggcacgagggtcgatcgattcatccaagccagagttgagcaatactagcagtgagatttacagtgatttcacttcgtgtttgttggtgagagagaagagcagagaagacaagatggcctccaaccagaaccaggcgagctacgcggccggcgagaccaaggcccgcactgaggagaagaccgggcagatgatggacaaggcggggcaggccacggaggccaccaagcagaaggccggagaggccaaggacaagacggcccagacggcgcaggcggccaaggaccgcgccgccgagagcaaggaccagaccggcagcttcctcggcgagaagacggaggcggccaagcagaagaccgccgaggcaaccgatgcggccaagcagaaggcgtcggagacggcccagtacgcgcaggagaggtcctccgacgcggcgcagtacaccaaggagtccgccgtggccggcaaggacaagaccggcagcgtgctccagcaggccggcgagacggtggtgagcgccgtggtgggcgccaaggacgccgtggcgaacacgctgggcatgggcggcgacaacaccaacaccgccaaggacagcaccaccgagaagatcactagggatcactagacgcatacatgcgtccaatcttgctaatttgcttcctttactcgtttggtcgttcgcgggccctttacatatttgtatgtttccctcttttgtgatttccgctcatttagtgtaagtttgccttcgatttgatgtactactcgtgtccggttctgtaatgagttacttataatccatgttttactttggtgtaaatggataacgaggacaaaaaaaaaaaaaaaaaaaaa

SEQ ID NO: 978 - DNA, 6697 bp, Triticum urartu
  misc_feature (1845)..(1957): n is a, c, g, or t
accctctcgttcgcccatccatctcccccaactccctccccagatccatccacttctcgccgccgctgctccgcaatctgccacgccgacggcaacgggagcgacggacatggccatgcctgctgctgctgctgccggtcccgggctggcgtcgacctgattccttcctttcgccggtaaagaatcctaccctaatcggacggatcgctccctccctccagtcgtttggggtttcgtatctgccttgctgtggcattgagcagccggggcccgaaccgtacctaatttgttgccgtctgcggttctgctaggtttgttcttttgcggcgcgcgaggtcgatcgtagttttctccgtgtagattagatcggtcggagctagtccgatggggtttggtgcccaggctcgagcgcaacttattttccctgaattttgcggggttcaactaaacccacaaacaccacgttcagtccgtccctcaggatgcaagcggacggcgtccacatttccccgtagcaaaaattgcattaatctctattactccctccgtagagaaatataagaacgtttaaatcactacaaagtttttatgttagtttacagagggagtactttaatataactgtactagtttaatttctatgttcgtggatggtcccaaacatgcggacatgcggacgccgtgtgcttctatccctacaccgcccttgctcaccaataatagagagggtgttgcatttgtcccctgcatttttttcggaaggtgttattgaggtaggtgggaaagcgtagtgggtgtacaaattgtggaaatgtacgtctccgactgttttattgattgacatttttcttcagaaatattaaaaccctacagcagataaaatgtccatgttgatgcaagggatttacgatgctctaaatcgaaaattgccatgtagtagtacaaaaaatgcctgaaaaattgccacactgcacagagtaattaccatgcgtttgattggaatttgattgggattcgacagtactaagggcgttcgctgggtttacttaaaaatctgacatttgctgggtagtggaatcctttttcttgctgaagagggtttttttttggctgacatgtttatgctattgcattgtaatgggattttgtcgcaacagttatagttttgggtgaaactgtggtacatggatctacttagttttgggtgagaccatttgattagagattgaactaaagaagtctaatataaaaactgcaacctgaatttcttcctaaaaataagacctgccatatgtgtacacagatctgtctatactttccaatgacttggctggttcttttaccatgattatgcactgctgcagttttcatatgcatcctgaatttcttcctaaaaagaagaccgccatatgtgtacagatctgtctatactctcgaatcacttgactgatttttttaccatgattatgcaatgctgtagttttcatatgcaccatcaccatgggtggcaagactcttcaggtgtcaggatttcctgcaactgtcaatgcagaccatgtcaaggatttgctggaacgaattgttggtgtggataacgtctgtgtggttaagctcaggcctccgaagaacaactctgcaaactcaagatcttttgccattgttcagttccagaccgaggcacatgcttcgctggtggtgaatgcggctcgtgggaatgcacttaggagtggaagcaattatctgaaggtccgacctgcggaacgtgacattgttctgagaccaagaactacgatttttaatctacggggtgcaacattgcattttggctgccttctgagggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaagagttttatctgttctgtggagcggaacagacgtttctgctgagtttggatttgctatgaagaagattgacttttgcctgacctacaaattgaagaaatacagacttgaactttcatatgagagcatatgggagatccagcttcatgatccacctggatcacaaaaaaagttccttttgattcaggtatgtttagctgtacaacacttgtttatgtatgctgaacatccttttcatgatatcattttacacgtacctgcaaattagtttaccattttgttgttgttgctaatttatgtgtttgctcctcattttgttttatgtactctgaaatgtttgtgtgttgttacaagtgcacaacaataattttcattttctctagagtactgatataatgataaccaatccatatgaagttatgctactagagttttacattagagcccaagatgatgggatgggaacaccaactgcagtatttccttgataattgcatacctctttaaaatgccgatccatctatggaacagctttttagttagttcaagttttttctgtttcttgaaagcttggagctctagatttgtcataacctcagtttgagaatttttgtcaattctcaggttctggctgctccaaaaatttacgaacaaaacttacagcattctggctctatgtacgacgatccattattcaactattttagggatgatactgatgatcagtggaccagaactactgattttactccattagccagcattgggcaatcatatattctgtgtctggagctaccacatgattgtgatctccccaacattcaagagtactttgtttactataaagaacacaagcgtgactttcattgccatcgtggacattcatattcaagcaatacttgctttgctccaattgtgaaatctctttatttcactgatatcccctatgagatactcttcaagatcaaccacatggttcagaatgggacacttagtgggccgacacttgatgacaacttctaccgtctggtcagcccgggatatgtatgtattgaccatataaagcgtgcacttgaaaatatgtcatacctaaaaaagacttgcttgaatccaacaaattggttatctgaacaatacaaagaaattaagagatcacgctacatgttaacatcaccaaacatagctctgaatgatgatgggttggtatatgtttacagggtgcaaattacccctgcaaaagtgtaattttatggtcctgaaattaatgtctcgaatcgtgttgtacggaattacgctgatgatttggataacttccttcggatttcatttgtcgatgaggactgtgagaagcttcgttcgactgatttatcaccacgttctgctcccggaaataatgcaaggagaactgctctgtacaacagaattctgtcggtcctttcaaatggcatcactattggtaacaagcactttgagtttttggctttctcttcaagccagctgcgggataactctgcgtggatgtttgcttctcgtccggggttgtccgccagtgacatcagggagtggatggggaacttccgtaatattagaaatgtggcaaaatatgctgcaaggcttggtcagtcctttagcgcctcaacagaaaccttgaaagtacataagtatgaggtgcatgtaattccagatataaaaaatggtacgaagtatgtattctctgatggaattggaaccatttcagctgattttgcagacgaggtgtctaagaagtgcaaattggcccgctttactccctctgctttccaaataaggtatgggggttacaaaggtgttgtcgctattgatccaacatcacactggaaactttctttaagaggaagcatgtcaaagtttccgtcagacaacatcacactggatgtccttgcatacagcaagtaccagccatgtttcctgaatcggcagttaatcactcttctttcaactcttggagttagagataacatatttgaactgaagcaacaagaagttgtgaagcagttaaacagaatggttactgaaccacaagctgctattgatgcaattgaacttatgcccatgggagagattaccaatgttgttaaagaattgctgttatgtggctacaagccggatgttgaaccatatctttctatgattctacaaacctttagagcatccaagttgctagaactgaaaacgaagtcaaggatattcatcccagaaggacgagcaatgatgggatgcttggatgaaacccacacactgaagtacggagaggtattcattcaagcttctaatagtgcaaatgacagtgacaagttcgtcgtaactggaaaagttgtcgttgccaaaaacccttgcctccaccctggtgatatccgtattctcgaggctgtttatacccctgttctggaccatatggttaactgtgttgtctttccgcagcaggggccaaggcaagtatttacaattgcatcgtgttcttctatgtttttcgaatatgtcttttagcaaaatctcatttctgtaaatatgttcttatttggtactagaaatcaacagtggaagataaaacaggtctgtacattttaaatcgaataaacttttactagttggcactcatggatgtcatattattacttcgatatcgtactcttattttctttgccctttgttatcgaaatcagcgtcgaatttggttcgtgcaggcctcatcctgacgagtgttcaggaagtgatcttgatggggacatatattttgtttcatgggacccagatctcattccaactcgtatggtggcacctatggactatactccagcaccaacagaaacattagatcatgacgttatgatcgaggtattttaagtttttagccgatattattcatattaaatgctactcatgataacggctgtacatccattgcaatgaactgtcatttagtcgtacttctgattgtgagtttctttttgactctgcttcttgtgtttctgaagagttgactacctgaacctatttcctgagatctgcatgttttagtttgtttgtttgtacttttccccctgatacaaaatgtaggcacttgtagagttggttacaagaactaaggatggtggtaggcatgttacccttcatttgtttcaaatactacccttcatttatttcaaatactactttttccctcccaaatacagtaaatgctagaattacaggctcaattgttgatgaaatttacgtggggctaattaggaacaacatgagaagaactgtattgggagtgtagacttaggatcaatttgaaaagatagaaatacctgtgttttggatcggaggaagtaggaagaaataaatctatttcttttctgatgagtacatacattactacttttaaggaaattccaagcatcctgtaaaaaaaatctgacaccctgctttggaactattctaatattatgcaggaagtacatgagtatttcgcaaattacatagttaatgagagtctgggaatcattgccaacgcgcacgtggtctttgcggatagggaaagcttgaaggctgaaagtacaccatgcattaagctggcagagctcttctccgttgctgttgattacccaaagactggagtgccggctcaaattccgggcgaactacatgtgagggagtatccagattttatggagaagctcgacagggtcacctacgtatctgagggagtaatagggaagctgtatagggagattaagaagcagagccctcacatagggcatttcacaaaggatgtggcaaggcggtcttatgacagtgatttgattgttgatggctaccaagactacatcgacgaagctgtgtggatgaagggagagtatgacttcaagttgggtaatctgatggagcactatggaataaaaagcgaggctgagataataagtggatgtattcttaagatggcgaagaattttaccaagagtagtgacgccgatgctattagacaggcggtgaaatcattgcggaaggaagcaaggtcatggttcagcgagatgaacgccagtgagagcggggatgttcctgaagccttgtatgccaaggcatccgcttggtatcatgttacctatcaccccgagtactggggttgttacaatgaagtatatggtcggccacacctcatcagctttccatggtgtgtctatgacaagctgcttctcatcaagcagagaaagaaacttcgaaggaggatgcagcctcatgtgcttgatctccagaatagcatgaggcgaaacaagattttcggttgagtgctaccatcaggctgtggtttgcgttgtatatatatttgaacatgtcgattctcgtgctagaatgttcgtcgaaggaattataattgcatatgatacgtgtttgatggacatgtgtgtatgaaccttggggtcttttggttgccgtcgttaaatatatttctgtggtttgatctgtaatcgtacctgcttttcccctgtctttttggtaatatgcatgttcatattaatcctgtgtttgaccagtgcttggtgcattgaaatgaatggaggatccaaatttagagattgtgagactgctgataactggtggtccggttcagaagagaaaagtactgaaaccacaaatagcgattcaactgatatggtctcgggtgtacttaacatgcttcagaaggtggtctcgttgagaaatgcaatgccatga

SEQ ID NO: 979 - DNA, 17107 bp, Triticum urartu
  misc_feature (2952)..(3047): n is a, c, g, or t
  misc_feature (14445)..(14789): n is a, c, g, or t
tcttgtctatctagccgtcattcatccagatatttcatatcaagttcacattctgagtcagcactccccttcaggttcactatggtcacctccttttatttctgcgagatctctcttgcatcttttctttcaatgctccagtttgctaaagcttcatgctattcaaatgctacttggattagctatccgaagggctgccaatcgcattttgcttgctcattgcctggaagacaaagaaacatactgtagtttcctgttcgagtgtagaggcgaattgcgagctatgattctcttgacagtagtactgacttggctacagtggttgtccgaggattttggtgtttctgtaactacaccaacttctctttgtctgacaatacatgtgttatcaacattgcgcgcgaccctatgaagcgtgagcttaccaagcatatggagctgatgcttcatgcggtcccgtgcaggatcaagtgattgcgctctttagtatgtgttttcccagcttcagttgatggatttcttcttgaagacccaaactagagcacaacacagcttttacctgtccaaattaggtggtgttgatccaccacaagtttgggggttgtgggttttagagttgtatatgtttttccagatattaactacataatccctattatatacttataagagattttttgcatatctaccacacctgtacatgattagctacgtgatccctattatatataagagtttttctgcatatttgccacctgtacgtgtgtgtgtgtgtatatatatatattggcttatggtctcatggaaatacaagttgcatatttctcacagttatagccactccttgacgccttttgctgttatgtcttaatccttctgatctgcaagcctcttctcttgttcctctacctgcttgttacaatgtctattgccaaaggcacatgacacttgtgatacgctattggtttgctgggactctttttagcgagcaatggtaggggaaccccccacctgaagtgaaaattttattgaacaaaaactcgatatgtacaaggagatttacgacgcggcaagctaagagaacttatgccagacacacgggagcgccattcgaccagcatgccattgctgagacgatatgagaagtgcaaatccgagagggcggcgtgctccaggatcatcctccaaacagcgagtggcgtgagatgctcaccattgaagactaatcggttctggcttttcagaagcaccgagcgcaaggaggaccaaggtgtggcggatggaatggtgcagatgcgctatggactgctcataaaagacgcagaaccggtgaaagagcacaccagaccgggctaggaccgattgtctgctgagatgccaagccagaaacaaattaaataggacgtggacaagaaccttgtctggcaccgtgtcgaaagggctggaggctgaaccaatccaccattgtcagaataggaagccctgtatgcgtgtgttgccatggcgagcgagccggaagaaggtctacactttctgcagagcaaaatggtcccagttaatgtttgccaagatctaggcctatactggagcgacaaagaatggggtaggctgctgcccatgacatgcttgtcggctttgccagccacaagtcggatggacagccaattggtcgagctctgcatcagccgctgtggtgaatggtgaggcaagattgcaagggtaggttgagggaaaccccagcaatcacctcagcaatggcagccttggcacattttttttttgattaatataaaatgctacagctgttaccggggatcttagaaattagttgttggactagcattgcactaacttgaaatattaggttggtctctagtgttgcctactccctgcaatgtaagtttttttttttttttaccatttgtggtcatgcatctgttcttatgttttatatgacaggcgggtctaacaagcttaattacaccaaatgtatcaacagccttgaagaattattgcatgccaaggtacatactactagtgttccccaagagttctgctgggtttaggaataatacttattgacatttgtctttgcaaaacttctctcatgttggataggtctgttcggttgataatgcagagctggaaagtgtgcttgcttttcctgatatggaggtgtacacttacgtcccgcttagtcactctaatcttactgtaacttacaacaaagaacttgatcgctcaaagcttgaggtaaagttttgttctgctatatagtcgattattattatttcaaattccaattatacaagcttgtgttttctgttctttttcatctcctttttgttatttctatgagtttgaaacagagtgaacgcatactacgcgagagcctatacgatttcaaggattctcagaagaaactaaagtccctggggaggttgcatggaaatttagtattctgtttgcaagaacttggttcgtttggagctctgcaagtaagttgacactgttttatcaaatacgttgataatgaaatatccttaagccttgttgtcggattcactctaatttggaacgtcctttctcttcagttagttggttcaatttttttcttttggggtgtggcttgggagctgttatcggatgctcctccctcgcttttatgtgaaagcgtccattttaggaacttcgtaaatacaagataaataatagattgtgttgtgtttaataaagaatgtttcttgagaatttgttatagaattagaaataacactatttttgggtgaaagtttatattgttcatatgcgatgcgatgttcacttagcttgtaacaaatgttccgagtggatttactacgagcctatggatgtacaagtgcttcatacatgcatacatggtgtttccgtagattgcaagaaagttttgttagttctcctgtggtggcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccccccccccccccccccccccacacacacatgggggatcacaatggtagctgcccttgtcatctaccgactccaaattcaaatccgcctaaggtgctgattccccactaacggactctaaattctgcccaaggcgaacctctgctaagtcagattttcctcctctagttggctgccgtttgagtgtctaaccttttgaagttgggagcataacgtgtacgcaggcgtgtatgatcttgtttgtcatggattctatatttcttgctttaatctttgcttatgcttttatttgctatttagttgtagtgttcttgactgttttctcctttgttataccacctccattcctaaatataagacgttggggtagtttaaattaaactgccccaacgtcttatatttaggaatggaggtagtacaagtgttttttttttacttttttgttgcctccttttaagatagcatcagatgtgttattccctattttgtttgattttagcgcaggctgcaaaggctttcctttcatctgatggtgatgttttggacagaaaggagtctgacatgaacgacaattctaccagatttaagcatcattacctaaacaaagcaatttctgttctgaattgcaacatattagacggtgagttgttatgcgtgttctcacctaattgttctccttttacccctatgttagttcctagatttatctggtccaccttccctataaattctggcagtggattttttttttagtttctaacaacaaatcgtcctggttattggctggatttgatatcctgcctgtaatgctgatccaaaattttcaaagcataaaagagaaatatgaactcattcatcttcctaaaataacaatatatcttactgtttccttaataacaatcagtactctggaatcgttgaggatatgtacctttcgataaggtttttattggaaatagttgccatcttaaatgcatattttttttttctgattagcccttcacgaatctgacaagacgtgctttctaggtacccatgatgattcatttcatctagagatgctagaagaacctttcttctcaaataaaattgtggttcttattaaaattctctcgagatacaggtgagcgtactcgtcagtgctactatcttttttcataacattctttatgctttggatttgtacgtacacattatggtaccggagtatctgtacttaatttagggtgtaacgaaatcttgttactgattgggtagcagtaattcctttccaccggcttacattttccacatgataatgtgaaaatgcaagaagaatctagctggaaaccactattcaaacattgtatttataaccacttgagaaagtttcaacatctatctgttctcatcatcctgcttattttgctctggtttctgcaataagcaggctagaggaaaacatgaagtgcatagttttcgtgaaaagaataactgttgcaagagcaatagcacatatcctccaaaatttgaaaggccttgatctttggaaatgtgagttccttgtgggacgccactcgggaccaaagaacatgtcaaggcagaagatggatgctattgttgaaaatttctcttctggcgaggtataataattggtgtaattaggcattcataccttctacatgaattcttccgaagacaataaaaagtgttctttggataactattttgaatatgtcacatcctgcatttattcttggcctgctctttcttcaagagtaagttaacattttttgtgatgtaaatatgtaattgagcacacctgggagcataatcataactaggtggttcgtactgatcttggttgttgttgaggtggatttttaatttcttattggtgcgcacctaactatgaatataactggttggcatacaacatcagggccagcatacacagactctgagatccaccagttgagtcagcgagtcggcagtttagtcaagtataagccaaattcagtttaactaggccatgggctaatcgtttctgatggacattagtgagctcctatgttgtaacggctgagtgagtaggcacttacaatatacaaggattgacacgggacagactgaaggattggttcttggcttgtaaagtgttgttagattatactaataataaagacatagggttttagtaggtctttttgactcaagcagggttctatcctggataggactcgtgggactaagggctttaggcctacatttgtattatccttgagttggtaatgcatgtggtaaattacttgcgatacacgccccaaaatctaacgttggccttatacccgtatatctactatgcttcttgcatcacaattcctttgcctttgctgtttgcaggtgaatcttttgattgctaccagtgtaggtgaagagggtctggacattcagacttgttgcctcgttgtgcggtttgatcttccagaaactgttgccagttttatccagtcgaggggacgtgctcggatgacaaattctaaatatgttgttctcctggagaggtgatttttccattaaatagatagacaattggtgttaatattataggtttgattgtactttagtccttgatttttgcccttcttattcattctgatacataccaggggcaatcattctcaagaaaagttgcttaatgactatattgatggtgaaggcattatgaatggagagatagacttgagaacttcaaatgatgtgtttgatcacctcgaggagaaaagttatcgagtggaaaaaacgggtgcttccattagcactgcatgtagtgtatctctactgcatcgctactgctacaaccttcccaaggacatgtaaggcctgctgtgtacatcaacctgttatgatcccatgcttttattcattagttctttgttgtactaatatgactaaacttcttgaaggttcttcaatccttccccagcattcatctacattgatgacactgaggggataatctgcagagtaattcttccaccaaatgctgcttttcgtcaagtggatggccaaccatgccaatcaaatgacgaggctaagagggatgcatgcttagaggcatacgtgaaattgtatgaattgggtgctttgacagattttcttctgcctggttcaggttcaggaaagaacagggcatcaacaacaaacggttcagcaagcaacagtcatgatggtatgttcactcacttgttcttacattgtcataatactggtgattcggctcagctattgtttgcatatttcagatgaaagtctaagagaagagcttcatgagatgttaattcccacaattctcaaaccttcaacatgcaaactggactgtccattgaacttgcatttctactatattcaattctttcccataccagcagatagacattatcggatatttggtctttttgtgatcaactcccttcctatggaagctgaaaagttggaggttgatttgcatctggctcgcggcaggattgtgaaagcaggaaagaaacaatttggggcggtattcatttgaaacatttagggacgatatcatttgacgaagaacaggcaccgtcttgctcattttttcatatgttaacatgtgatcatttattgaatggcgtataaaatgttaacattgttttttcttgtcagatgatgctggcacgcaatttccaagaaatgtttctgaaggttctcctggacagatctgagttcactgtatctcatgttatgttgttgggcaacagtgaaacgctacagtttaattcaaccttttacctgctgcttccaatcaagcaggaattgtatggtgatatatttatgattgactggcaaacagttaagcgctgtttatcatcaccggtttttaaagatccaactggtgtgtctgcgcatggatcatatttgccagatgagtctttaaggcttcttgataatatgtacagtaaaactgatgtcgttggcagtctaatctttgctccccatattaagacatttttcgtcattgatgtcattctgaatgaactaaatgctagaagtgaatacgacggtgctacttatgaagatcattacaaggaaaggtaacaaactgaaggattatttgcatcccccttctttgctttcaattctcatgctaccgtcattgagcactcactaggtcatgtatagctacataaccaaccttaagattgcgagctatctgtaccatttatgaatatacaaatttatgtttagtatgataatttgtatctacttcacctatgtcttctaggcatagccagtcccaagcccaggtaaaggaggagggttgtgataggcttggcgagccaacgtaaaaactagccagtcccatgggtatgaaacccatttgagcgagagtagtactaggatttcatatctaagggttgtcctcgtgaaagggtttcatatctaagggttgtgataggcttggcgagccaacgtaaaaactagccagtcctttgggtatgaaacccatttgggcgagagtagtactaggatgggtgacctcctgggaagtcctcgtgaaagggttttatatctagcctaccccaacttgtttgggacaaaaggcttagtaagggaggaggaatgtgtatctacttcatgttacgaaaagtaggccatgcaagtcaaagatataatatcatgggaccaccccagtagaaatccccataagaagctttagttttgggaaacatgttagcaaatgtgctgcttctgtcctggctttacaagtagtctatgtgatggtcgtatgataggtccactgaactgatcctagtcatccctggtagccttttctcggcaactaaccaactttttttataagcagtttaaaagaaatgttgcgatatttctgcttaagtgctttattgatgttctaatgaactgatggacttttcaaatcaggtttggtatcaaactatcacatcccgagcagccacttctgcacgctaagcagctctgcaatctgcataatttgcttcatgaccgattacgggagaccacaggttacactttttgtcccttcagaactagtacctttataaactgtttcctgttttggactcttctttatccaagcatcactattttgcttagcattaaaatacttctaagtgttcaacttgccgtaaagtgaagaaatatttgtgatggtcgtctgtagtttttttagagggcatgcatcttttcattaagaggagaagcaaaacataagtacaatgttaggaaatatgcaacttgtctttccagatgaccatgggccgatcatctctgcaggagtgtacaatttttaacacacgtgtcgatcgtctcttaacgccacttgcaccctgtgatggtagtgagccaatattgctctatgtaaattcttgctgtcaaattttcttgaaccgcttgtgaattgctttcaacattctggaactacttgtggatgcattggacctaggggtgggcatattaaccgagaaccgttgcaccgaaccgaaagaaccgggaccgaaaccgaaaagtttggttcctatttcggttattaaatctatagaaccgaaatttattctctaatttcggttttaacacttggttaaccgaaaagacctaacaacccgaaactacagagcatgcctcgcacctccgtatttttctgttgaagaaatacaccacacacttcctgtattctgtatccccgctgtcctaggccagctggcccagctagcccaacacggcagctccaagtctctctatgcctttttcacttatctcactttagccacgtacacgtctggtatggcccaaaaagtgtagcaatcggcccatgcaaaaataggtttactgtagtaccacatcggatagccactaagaaaggaagcgtgtgaaaggctataaaaggtactagctagctagccatgtttcatgtgcctgctcgtacggaaacttgcggagtaaggccaaggaagaaaatgtatccgtgcgcatgaagttcggatctgttcggttggaaccgatgacagaaccgattgttcggttccaagaaaattcggttacctaattctgcaagagccgattggtctgcaatttttagaaaccgaaaaactttgtgacctgaaaaaccgaaccgatcggtccggttagaccgaatgcccaggcctaattggacctagttcttgcttctctggtttaagcttttgagcactgttgattcaatccatttatgaattgtattctgaatatactgctctactatgattccttaaatgtaccctatctaggtatagtatttctgatggtgttccttttcttattttgttatttgtatttagaagaaggtcgtgaattgatggagcactttgtggagttgcctccagagctatgttctttgaagataattgggttttcgaaggatatgtgtagctccctgtctttgttaccatcgttgatgtgtcggttggagaatttgctggtagctattgagttgaaggatgtcatgttgtcttcattctcagaggcttctcaaattagtgcctctggtgtaagtcatgcaattttcgcacccttcatgctgaacttctagtttgaattacctatccatgctgcaaatgatgttaatctatttcagatccttgaagcacttaccaccgaaaggtgtttggagaggatttctttggagcgctttgaagtcttaggtgatgcttttttgaagtatgtagttggacgtcacaactttcttacatatgaaggacttgatgaagggcaattgaccagcagacgttctgctatagtgaataattcacatttatatgagttatcaatcaaaagaaatttgcaggttagatattgttttcagtgaacccaatatctgtttcccttccaagttttgtgtgacctatgggttgtgttatctttgtttcaaatgtagaccaagttcagtaggctcatcttctgcccatgttatgccttgatttgtctgatcatgaccagaacatgtagggaagagctagatcagggtcgtcaagagagaccatggacaaagagaagagataatcatttttatttgttgtcaattgattgcaccctatgagtttatatagcaccctactcaatctcttcagattcttgactggatacaactccttggataacccctatcgccagggtttctgacctagtacatctcatttaaataaaaaggggttaatctcaactggattagtgtctaaccagacctaggacaccagctcggcttgactagctgagtctaatacaacttaaaacggagtcatgcaggattagctctgcctcttgagggccggtcctggggcgacagaactggtcgcatgtggctcccatgtgggttcaccattggtaccctatgcccaacacaacagctttttaaggttaaaattggagagggttttcccgcatctggatcgatttcacagccttcagttttttttttcaaaatgtttcaaaaggcgctaatgcataacaaatcagcttagaaagggaaaataaagtgacaaacataattgtcagaatgtgtccagcttctgcggagccaaccattcaagcgatgaaattaaaatccaaaactacaacaaccaaggactgaagctggtccaaccagtgtacagacaaagggcattcaccctggagatcacatcaccatcttgctagacaaatcctgcaaggagatgacacatgtatgatgatgttgcgggatctaaccattgattggcagattgagagtctgcttccggatagtaggtaccactgcacaagaccgccgtaccctcgtcggatccaatcagtgaaggcctggtctcaaacatgaagacagtgaagaagaccgctgttgccagatccaaccattgaaggcccgatcaagggtttctaccccgtaaaggatgaaccattgctctaagctgccgtctatgacagctgataaagtgtaactacaatcatcacaagaaaagcaagattagttcacaatctgccagagaaggccttttctagatggactcgccatgtgactatcagaattgaacttaaagctgcatgtttctgtcaatgttgcgaacgatagccaggcatatactcattagcgtaactgaacgatagcctactttggaatagttactgatagtgacattatagcctttatgagctctgtattatcttggcctgaccataattatctacagctaataaagtgaactacaatcaccacaagaaaagcaagattaagccgcaatctgccagaaaaggcctttcctggatggactcaccatgtgactataggaactgaacttaaagccacacttttttgtcaacattgcacatgatagccatatactcgttatcctccttacttaggaataattgctgattgtgacattataactttgatgagctctgtattatcttggactgaccataattatctacgacggtagtcaaacattctgtttatccttatgatctaatttaagtacatcctcttatttaaaacatggtttgctgccttgtaacattttaatagaggtccatgatccttgtttctgttgcaaaaaaaaaatcattacacaagataatgagttattttccctgtcaaatacctgccatgaattctgtagcgtaactgaacatctttttttttgcatgtctgtgtaaacttaggtgtacatacgggatcaacactttgaaccgacacagttcattgcactgggaaggccttgtaaagttgtttgcaatgctgacacagaagtgaatatacacacagatagtcgagaaaactgtaacttgaggtgtacaaagtcgcatcattggttgcataggaagactatagcggatgctgttgaatcgcttgtcggagcatttcttgttgaaggtggattcaaagctgcatttgcattccttcactgggtgggaatagatgttgattttaaagattcatccctatatagagtattagatgcaagctccatcaatttatctctcacgaaccacaccgacgtcggtgagcttgaggaattaatcggttacaatttcaaacacaagggtctaattctcgaagcatttgtgcatccttcattcaataaacattctggaggatgctaccaggtcagagcttcttttttcttgcattgtcattggtgaactgatgtagtaatcaatgatttactcggctgactatgttcttttcgtatttgatcagaaattggagttccttggagatgctgttttggaatatttgataacctcgtacctctactcagcttatcctgatctaaagcctggtcaaataaccgatttaaaatcgttagctgtcagtaataattcgcttgcatatgtggcagtccagaaaggtatccataagtatcttataaaggattcaaattatctttcgtcagcagtgaataagtttgagaattatattagacttcccaattcagagaaagacttggtagaagaaccagcatgcccaaaggtattgttatatccttgtaactgctacgcctctttagataacccatttttagcgtgcacaattactgctaaaatatagtgattattaaagttttcgatataagatgggatagtaggggtcagccgacttaaaacacaaaacaagtattatcattatcaataattgtataggaatcatacattttttagtactatggttatatgattttcttgagtaactagttgttgcatttgataggaatcatacatttttttgtactatggttatatgattttcttgagtaactagttgctgcatttgatgtatttgatttctgtttgacttgtaggatttctttagcaatcacatactttatatggcataacatttttatggcaaacacttatatccttttactgtaatcttgcttgcaggttcttggtgatattgtcgaatcttgtgttgctgcagttcttttagattcaggattcaacctgaactacgtttggacgctagtgcttatgcttctaaagccagtgttgagcttctctgacatgcacatgaatcccatgagagaaattcgggaactttgtcaatctcatgaacttgagttaggccttcccgaacctatgaaagccgatggagagtaccacgtcaaagtggaagttaacataaacagccaggtgataagttctgccgctgcaaaccggaattcaaaagttgctaggaagtttgctgcacaagaaacactttctaaactgaaggtatattttggttacttggccttctatttttggacttgccacagaattgtgacgtttgagccattccagttgggtgcacaaaaagcaatttctaaactgaagatctgcctttggtgcctttgacttttgttttgcaattaccatgaaatacgataatctcaatggtttcatttgttttttataaactgtcaacatgcattatggtatttggtttaaatattctggtccatcatgggatgataccatgattttgatgggatgacacttcccatgtatgtaattagcattgtgcttacgagggatgaggtggcaatggaccaacacattccattcctaaattcaaaccaaacaagtgcgcctcattcattttccggttccttgaactaaacactttatatgttcatgaccgcagataaattgcacacctaataaccaaactatgctgcacatatctaccacgatcgccgcaacgcatcgaagcttgccgccatatcgagaactgcatttttcatccccaaattatgtgcttgaaagacaaatacatcaaatgccaatcctttttttttcctttttgtgtctgggtatcaccatgacaacctcacgacattgacaaggtagaagaggctggtgctggtgatcaggaacaacgatggtgtgattagggttaggcgggaaatgaagctctataccatgtaggaattagaggaaataattatgtgtgtggattacaatcccaaccagactttaatatgtatacaaccagccagtggtggtgccaggactacaaacatgtgatgtcaaacatatttctctctgaatcttatattatttcttgtatttgcacatgtaatttgtatgtaaaggttttgctcaaaacctgtgtagtcaattgactatgcagtcataacatggcctggccactgcaaccagtctctttttagttcgtcttgaacatgcatttcagacttttccttgaacatgcatcaaaatgtttgccattgtttgttagaagaaccctggaaaaggtctggaagtaaaaaaccaacaaagggtggatacaattggacttttatagactggaatcagaatacttttaatatcacgaactagtgccttgtcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttatggtcattatgtgattcatgtcttgtgaaaatggttattatatactccctccgtcccataatgtaagacgttttttgacactacactagtgtcgaaaaatgtcccatattacaggacgggagggagtataatttaaccatgtaagttcacttgctatgttacatgtttttttctgaccaattgaatatttattttggttattatttctatggtggtgtcaggcaaattactgtaacatgataattttcagtattgttgaatgattctgttacttaaaaggctaaagcgaacttactgcttttgtgaatccttgtgcactcatgcagaattatggatacacacataaaaacaagtcactggaagagattttgcgagatgctaggaagaaagaaccagaactactaggttataatgaagaaccaatcaaagtcgaggctgacatatctgcagaaacaaataatctgaagataggtaaagaaagggatgcaaacatctctttccaaaatacagcaatttctattcgtgggactcttagaacctctagccaaagaacagcagggaataccatgttttccaaggatgatgtcagtattgaaaggaataatcagctcaaggttgcaaagcagaatgcctgtctgccgaagggaacaactcagaaaaatattagaaaggagtatcatggtaatgctaaatctaatacattttttatgcaccgtaatgctctccattagaaagttgaaaaaaaatatgcacactgtcgactttgacctcacatacctggtggcactgtgaacagcacttaaattttggattaattagccatttgttttgtcttttaaccatgatgtatatattcttatgaagatacgaaatgtctgtggtacttctcaagcaccaagtttgcagtatttgtggtttaaatttggtgttgaaacattctacatggaaagaagcaattacacatttcatctgactgtttattgtgcattcaacttgattgtgtcaaaacaacttcatctattgagtgggagataacaaatagacccagatatatcgagttaatgttttaaggcgattgagtttgctaaatttgcaggatatacaactatgttttattattcacacttcaaatttcgttctaattttaaaggaagcgccttaacgcttttaatcacctttgcaggtgatatggtaaataaaacagcaaagtctttcctttttgaagtatgtgccgtaagttattggataccccctgaatttgaattgtgcaaagaagaagggccaagccacctccgaaggtaagcttgcttgaaggagaacatacatcaagttgcctgcattacaaattacaatgaattatagtctccttgtacggttccttttcttacagagtttgtggtttcttcagtgtagaaaataaaaaatatgtttcttatccatcataatatatgtccatttctaagttccttatttttggtgtttatcctggtaaggagagtggcatgtcaattctaggttaaatagtgctctaaaaaggaggattaagcagaatctaagcacagacactattcttaacctcaagctttgcataaacggtagtttcgggtagcttaagctggcaaggaccgtcattattaagcagttgctttaacagtttgagagcagtgtacttttttatggaaaggtctcaagaatatttgtcaatatctaacttgtttaggaaaattgccagcaagtctggaaaggtgttatctactttgtagtggtattctggtatttgtcatacaagttcactgtggtgtactgcttcagagccaagcatttgctactagtcaaatactatgatttcagtgggtatgatataaaaaaaagcaagttcagactatagtgaacacataaatttaaaatcttaagacatgtttcactgtcattttatttggttacgtgataatgcttcttcgtgatatgcattatatccaattcaggcgtgaatataaaatgcaacgtaagtatatgaggtgataaatgtgttgctgtctagtcacatagtgtgttgtatttgttacaaaatgttgtggataccaattattttactatcaaggtgtgtacatgctccgctaacttcatgcgtgaaatgacacagattcacgtacaaggttacagttcagatcaggggaccctcggagacactcttggagtgctacagcgatgctcaactacagaagaaggccgcacaagagcatgccgcgcagggggctctgtggtatctcaggcaacatgggtacctacccaaagatgaagttcgtgtgtag

SEQ ID NO: 980 - DNA, 5861 bp, Triticum aestivum
atgaagaaagcaatagcaatatactaaacgatcaagtgctaggctaacggaatgggtcatgtcaatcacatcattctcctaatgatttgatcccattaatcaaatgacaacacatgtctatggttaggaaacataaccatctttgattaatgagctagtcaagtagaggcatactagtgatgttgtgtttgtctatttattcacacatgtatcatgtttccggttaatacaattctagcatgaataataaacatttatcatgatatgaggaaataaataataactttattattgcctctagggcatatttccttcaagaacaactagttagtgattttagactgtatatagattgatgtaagaaccgattcagtaaacattaagttgatatttgattgagttgaaaactgcaagaacccctcccagtttacccaagaaaagtccctgcccgaaagtataatgggggaataaagtgaaaaagtgaaatcaagcaaataggagaactaaccaacaggagaaaaacgatgaaattgacatacaagcccaatgaaaagaggcggcgatgcagggaagaacacagggtggaggaacaataattttggttaaaacaccaaaaaggtcaaggacaagagtgaaaagagaaaaatcagaaaccgcgaaagtgataaccaaaaaacgtgatgtgatcgcctctccttccaccatgtgtcgagcggggagcgtagcggagaatctcctcgacatgcgacgtcccgccacttgtcacgcttggaagccacgagcgataatacccaagggtaccatttaagtagttatttcggttccaaaaaaagtagttattttggtttttttactagcagtggcatgaattttttgctgggatgattatgcatgttttttttaggataggatgattatgcacgtgtttggtcaaggtgcaaacgcgcggtgattgggtggctctcctccgcttgcaacctaccctaaaaacatggttaatagtatagccagctgctggttataagccagtgccatgtcatttacagctcattttatagtcaacatgtacaatagtagataaaaaagtgtactactgttttattatgtggcccaccttttattctcacaaagtgcccaagagcacgtgcttgagctagctcttcacgaagagcccgcttaccttttctcacctcttctctttcctccaactaaatagaaatatactaatttattccttataacctgctaactcagctctattgtacttgctgtaagctgggcttctctgggcttgagctcgtttcgaactcgaccgtcgcaaaatttcacatcacaataaaaggcgaggtagactcggaaaattaggtcaaaaagtaggaagagaaacgcgatagcccctcgcctcgccgccgccgccgagcagcgcacctgcccttccgccggcgaatccgctcgtgccctagccggagactaggtattggcgcagatctgccggcagcgatgtcgggaaccgcggccccacggtacgcgccggacgaccctacggtgccgaagccgtggcgcgggctggtggacggcaccaccggctacctctactactggaatccggataccaacgtcacccagtacgagaagcccgtgccgccggaagctcagctcccgccgcccccgcctctcccgcctcctcctccgcgcgcccgcggccgggaccgtcgagaccgttcccgttctcgctcccgctcccgttctcgcacaccgcctcggcgtgaacaccgggaccgcgaccgcgaccgcgacaggcgccgtcacgacgagcacgactcgttcaagccgtcgtcgtcccatcaccatcttcctccggctgccaccatcatccctaccgccgcagctgatgatccatcagccgaagcataccgccgtcgccatgagatcacagtcatcgtaaggatctcgcagctatcctcgtgttacctcatagcatgtttgtgttacacatctcatagcatgttcgttactcagtatctattttttttgtttggtctgtgatgcagggggataacgtgccggctcccataactgagtttgactctggtgtcatcccgcttgatatactcaaggaggtatgcataagtttggtgatgaattatcacccaaggtctaacactaacccaaaagagtttgataagggtcagcatgttggatcacggggatgcgctcttctttatctttatctgtttgattgattgttctaaatcagggacgcttgcgagtcagttacttatctacatctctgtggcagatgcgatattcgctccaaggtggagctaatgtcgcaccctgcttcgtgcgccctcgtccagtctgtaatttcgacgggctgagggcggatgtcgttgatggagctgccaagggtgggtggacaccccaggcggcttgctccctgctaagggggctgcccatggtctaaaaggccatctacgtcggctgacgctgatttgtttctccgcgtacggttcctggtaaaggctcctcacatggatggcaggcctcttctgggggctatggagatctcacccaggctgaaggcctccaaatgcctgaccaatggaaggggcctgtggatgaacgatccatggctgagcgagcctgtctccagggattctgttagagcttttctacttcgccctgtttccacactttgtggatctgttctcttccgtacggccttaaattgacttcacacattgttgattctttgttgttttcactatatagagtaactagagtttcagtgggagctgtagcagatgtaggtgcatcacattaaccatattcttttggtgtccttattttgtttgcctttgccttccgttcccctttcttttttccagatacaacgcgccggattcccaagtccaacgcctatccaagcccagtcctggccaattgccttgctcaatcaagatgttgtagctattgccaagacaggatctggaaaaactctcgggtatttgcttcctggctttatgcatataaagcgtatgcagaacagcacaaggtctggcccaacagtgttagttttggcacctaccagagagctcgcaacacagattttggaagaagctgtgaaatttggcagatcatcaagaatttcttctacggtgagttttctttgccttgcttcttcctggattatatgttcatcatctgatcctttgttcttggtctcttcttagtgcctttatggcggtgctcctaaagggccccagttaagagatttagaaagaggggttgatgttgttgttgcaacacctggaaggttgaatgacattctagaaatgcggaaaataagcctaaagcaggtctcgtaccttgttctagacgaggctgaccgcatgctagatatggggtttgaaccacaaatacgaaaaatagtaagagacataccttctggtcggcaaactcttatgtacactgctacttggcccaaggaagtccgaagaattgcagatgagcttcttgttcaccctgttcaggtgaccattggaagtgtggatgagcttgttgctaataaagctattactcaggtacgcgacttgctttgtacactgcactgatgatacttggaaatatcttctttttttttcctttcaccaagtacatatcttttaattttctgttctgttctgtcttctgctcctgtgttctgctcctgttgctctgccagcatgtggaggtggtcactccctcagaaaagctttggcgtctggagcaaatattgcgatcccatgattcaggttccaagatactaatattctgtaccaccaagagaatgtgcgaccaactatcaaggacactcaataggcaatttggagcggctgccattcatggtgacaagtctcaaaatgaaagagagaaggtcctgagtcaatttagatctggacgatctcctattttggtggctacagatgttgcggcacgaggtttagacatcaaagatatcaggttagtcaataatattattctaatgattttattgctatattggtgctgcttcatgtatttatatgacatactccctccgtccgtcccaaaataagtgtctcaactttgtactaagcttgagacactattttgggacagtgggagtatttgaatgtctaaatggggctaaagaatggttcccttgcgacccatggtagcagaagtgcatgacaaggatacctaaaatttcagtagatagcatgtgtttttggttgtgtccaaaacctgtgctaccaatgtttggtcgttaccaaaacttaggtccttaatgggattgcaatttttccggcatgttcatgcccctttgcccattctagttcatatgcgccgccattttttctggctcggtaggcctttgcttaaaccaatcaggccctaaacaaggaagtgcagtcaatatgccctcagaagctattcattatcatggcatgtccagctgtatatttgctgaaattattctggatttaagttcatataactagtgcaaatgtacacacagaatcttgaagaaagctgttgtttaaatcagtattgttctgatctttaccaccagtgcttcaaatctcagaaatgatctcacaatatcctcttgctttcttgacatagggttgtgatcaactatgacttccccactggtgttgaggactatgttcacaggattggcaggacaggaagggctggtgccactggtttggcctatacgtttttgtgtgatcaggattcaaaatatgccgccgacctaattaaaatcctggaaggggcagaccaagatgttcctcctgaactgttagacatggtctctcggggtgggcgtggtaggaaacgtaacaaatgggcaacccgctctgagaggggtggtggttcacgccctgaactggattcaaggtatggtggcaggttagagggtagtcgcggtggacgtggaaaggatgattatggtggccgtagcaggttcgttctgtcccttccattttgttttctgcaattgctgaagaaaacagagtttgggtcttgttagtgttaaccgaagtaattcgagattataaattctttcgtcgttgttgttcggtagtttgtgttcctgagccaaggaccatggtctttacaatgttgctgatgtttgcaggaatgatcacggcgggtctcgcaggtctgctagaggtcgcagcagaagccttagcaggagtgacagtgataggcgcagcccaagccccaagagacggcgccatgatgtgcagtctagccgtagcaggactagaagtcggagtcggagcaggagcaggagcaggagcaggagcagaaacaagagcaggaataggagccggagcaggagttacactaggaatcgtcgtgctagccgcagcaggagtcgtagccctggcgctagacgcaggcctgaaagaagagctggctctgggtctacacgtcctgactctgcccacccagtggagaagaaaagctcacccaatgctcacccttcaaatgaccacaggagccgcagtgtcgacccttcaaatgactatcaggcggaggatgggaagatgggaaaggttgatctggatcggtcgcccagtccgcaggagcaggatgacaagtctgctccatatagttctgtgtataatggcgaaggaggcagggggtcaatgagccctaatggcgagccagtggtggatgctaaacctgtggaagtctctgtgagcagcaagaagagggaggatgaagaggaaggtatgattgatgaagagggagaggagggtatgatagccgatgatgaccctcgcgcaagtgcagctgtgcaaaacggtggtgataagtga

SEQ ID NO: 981 - protein, 954 aa, Triticum aestivum
GRGSEDRTHTPTPTPTGEDRRDGTRIAARMDPHDGEPAADELPPPPPLPPNVVPIIAEDAAAAAAGESEPPPPPPPPSKPAKPRKHIMARPPNGLGKKGQPIQLLANHYKVSVKPSEEFFNHYYVNLKYEDDTPVDSKGIGRKVLDKLQHTYHSELANKDFAYDGEKSLFTIGALPQINNEFIVVLEDIGSGKTAAGSPGGNNGSPGGGDQKRVRRPYQAKTFKVELNFAATIPMAAIGHAIRGQESEHSLEALRVLDIILRQHSAKQGCLLVRQSFFHNNPSNFVDLGGGVMGCRGFHSSFRGAQSGLSLNIDVSTTMIVKPGPVIDFLLANQKVDHPDKIDWQKAKRALKNLRIKTTPANSEFKIVGLSERNCNEQMFPLRRRNGDSTETVEITVYDYFVKNRGIELRYSGNLPCINAGRPKRPTYFPVELCTLVPLQRYTKALSTMQRTSLVEKSRQKPHERMSTLNDALKRSNYDADPMLKACGISIAQNFTQIEGRVLPAPKLKAGNGEEFFTRNGRWNIARKKLIRTSSVKRWSVVNFSARCDLRGLVQDLKRVATGMGLEYEDPHTVIEESPSLRRAPVARRVEEMFAQIKAKLPGAPLFLLCLLPERKNCEVYGPWKKKCLADFGIVTQCLAPQRVNDQYLSNLLLKINAKLGGLNTLLQIEAARAIPIVGKVPTIILGMDVSHGQPGQSDRPSIAAVVSSREWPLISKYRATVHTQSPKQEMMASLFKPRGTEDDGLIRESLIDFYTSSGKRKPDQVIIFRDGVSESQFTQVINIELEQIIEACKCLDDKWEPKFTVIVAQKNHHTRFFQANSPENVPPGTVVDKQVCHPKNFDFYMCAHAGMIGTSRPTHYHVLHDEIGFSGDELQEFVHSLSYVYQRSTTAISVAAPIAYAHLAAAQVGTFMKFDDMSDTSSSQGGGHTSAGSAPVPELPRLHEKVRSSMFFC

SEQ ID NO: 982 - protein, 915 aa, Triticum urartu
MPSQPPTQPLLTRTERRRPFSASGLLARGPSGTLAWPCQKITLLCCAPLSIGSSIWDPDFFPHLIDSILQGFFRFNWIFFWSQLNEVSINPESKSRAVNREVLSELIKLHGKTSLGGKLPAYDGRKSLYTAGSLPFESEEFSVTLVDPEKKDKEKAEREYKITIRIAGRTDLYHLQQFLKGRQRDMPQETIQVLDVVLRESPSWNYVTVSRSFFSTTFGHRGDIGEGLECWRGYYQSLRPTQMGLSLNIDISATSFFKPVTVVQFVLEFLNLRDASRPLTDRDRVKIKKALRGVRVETNHQEDQIRRYKITGITPVPMSQLIFPVDERGTRMSVVQYFMQRYKYNLQYTSWPCLQSGSDARPVYLPMEACKIVEGQRYSKKLNDKQVTNILRATCQRPQQREQSIREMVLHNKYAEDKFAQEFGINVCSDLVSVPARVLPPPMLRYHDSGKEKTCAPSVGQWNMINKKMINGGIIDNWACVSFSRMRPEEVYRFCCDLIQMCNMTGMSVNPRPLVDNRSASPNHIENALRDVYRRTTEMLGKQGSEKQLQLLIVILPEVSGSYGKIKKVCETDLGIVSQCCLPRHASRPNKQYLENVALKINVKVGGRNTVLERAFVRNGIPFVSEVPTIIFGADVTHPPPGEDSASSIAAVVASMDWPEITKYRGLVSAQPHRQEIIEDLFSVTKDPQRGNVNGGMIRELLIAFRRKTGLRPERILFYRDGVSEGQFSHVLLHEMDAIRKACASLEEGYMPPVTFVVVQKRHHTRLFPEVHGRRDMTDKSGNILPGTVVDLMICHPTEFDFYLCSHAGIQGTSRPTHYHVLYDENHFTADALQSLTNNLCYTYARCTRAVSVVPPAYYAHLAAFRARYYVEGDSSDGGSTPGSSGQAAIAREGPVEVRQLPKIKDNVKDVMFYC

SEQ ID NO: 983 - protein, 1120 aa, Triticum urartu
MVRKKRTGPGSPGESSGEASGASGQGSSQRAERAPQQHGGGRGLAPQQHGRGGGQQQGRGGHYQGHGGSASHYPGGGPPEYQQRDYQGRGHPGGGPPEYQHRDYQGRGHPGGGPPEYQPRDYQGRGHPGGGPTEYQPRDYQGRGGPCPRGGVPQPYYGGHRGGSAGRNVPPGPSRTVPELHQAPHVQYQAPVVSPSASGAGSSSQPVSEVSSGQVQQQFQKLAIVDQSSTSQSSQLAPASSKSVRFPLRPGKGTHGDRCVVKANHFFAELPDKDLHQYDVSITPEITSRGVNRAVMAELVRLYRHSQLDGRLPAYDGRKSLYTAGPLPFPSKTFEITLHDEEESLVGGQVAPRHERQFRVVIKFAARADLHHLAMFLAGRQPDAPQEALQVLDIVLRELPTARYSPVGRSFYSPNLGRRQKLGDGLESWRGFYQSIRPTQMGLSLNIDMSSTAFIEPLPVIDFVAQLLSRDISVRPLSDSDRVKIKKALRGVKVEVTHRGNMRRKYRISGLTSQATRELSFPVDDRGTVKTVVQYFLETYGFNIQHTTLPCLQVGNQQRPNYLPMEVCKIVEGQRYSKRLNEKQITALLKVTCQRPQEREKDILQTVHHNAYYEDPYAQEFGIKIDERLASVEARVLPPPRLKYHDSGREKDVLPRIGQWNMMNKKMVNGGRVSHWACINFSRNVQDSAARGFCHELAIMCQISGMDFAPEPVLPPLTARPEHVERALKARYQDAMNIIRPQGRELDLLIVILPDNNGSLYGDLKRICETDLGLVSQCCLTKHVFKMSKQYLANVALKINVKVGGRNTVLVDALTRRIPLVSDRPTIIFGADVTHPHPGEDSSPSIAAVVASQDWPEVTKYAGLVSAQAHRQELIQDLFKVWQDPQRGTVTGGMIKELLISFKRATGQKPQRIIFYSIFRDGVSEGQFYQVLLYELDAIRKACASLEPNYQPPVTFVVVQKRHHTRLFANNHNDQRTVDRSGNILPGTVVDSKICHPTEFDFYLCSHAGIQGTSRPAHYHVLWDENKFTADELQTLTNNLCYTYARCTRSVSIVPPAYYAHLAAFRARFYMEPDTSDSGSMASGARGPPQGGRNTRPFGNVAVRPLPALKENVKRVMFYC

SEQ ID NO: 984 - protein, 868 aa, Triticum aestivum
MGKCGDRCVVKANHFFAELPDKDLHQYDVTITPEVTSRGVNRAVIAELVKLYRQSHMNGRLPAYDGRKSLYTAGPLPFTSRTFEIALQDEDEGLVGGQATPRRERQFRVVIKYAARADLHHLAMFLAGRQPDAPQEALQVLDIVLRELPTARYSPVSRSFYSPNLGRRQRLGDGLESWRGFYQSIRPTQMGLSLNIDMSSTAFIEPLPVIEFVAQLLCRDISVRPPTDSDRVKIKKALRGVKVEVTHRGNMRRKYRISGLTSQATRELSFPVDDRGTVKTVVQYFLETYGFNIQHTTLPCLQVGNQQRPNYLPVEVCKIVEGQRYSKRLNEKQITALLKVTCQRPQEREKDILQTVHHNAYYEDPYAQEFGIKIDEQLASAEARVLPPPRLKYHDSGREKDVLPRVGQWNMMNKKMVNGGRVGHWACINFSRNVQDNAAKVFCHELAIMCQISGMNFAPEPVLPVLSARPEHVERALKARYHDAMNASKPPGKELDLLIVILPDNNGSLYGDLKGICETELGLVSQCCLTKHVFKMSKQYLANVALKINVRVGGRNTVLVDALARRIRLVTDRPTIIFGADVTHPHPGEDSSPSIAAVVASQDWPEITKYAGLVSAQAHRQELIQDLFKVWQDPQRGTVTGGMIKELLISFKRATGQKPQRIIFYRDGVSEGQFYQVLLFELDAIRKACASLEPNYQPPVTFVVVQKRHHTRLFANNHNDQRTVDRSGNILPGTVVDSKICHPTEFDFYLCSHAGIQGTSRPAHYHVLWDENKFTADELQTLTNNLCYTYARCTRSVSIVPPAYYAHLAAFRARFYMEPDTSDSGSVASGARGGPPQGGPRSSTRFGNVAVRPLPALKENVKRVMFYC

SEQ ID NO: 985 - protein, 107 aa, Triticum aestivum
MVCGGPPCQGISGLNRFRNYNEPLEDDRNKQLVVFMDVVNYLRPKYVLMENVVDILKFADGFLGRYALSRLVSMRYQARLGLMVAGCYGLPQFRMRAFLGGALPSRV

SEQ ID NO: 986 - protein, 758 aa, Triticum aestivum
MSNQPDTLLHGYRPVLDRPEDEEDMKARVHYRSAMVDGVVYALGDDVYVMAGENEADYIGRITEFFEGVDKTSYFTCRWYFRPEDTVISRAKFVNDHTHDPKRVFLSEEKNDNLLDCIISKVKIIHVDPNMDPAAKAKLVARTDLYYDMSYTVAYSTFANIPSDTTENSGISTDADSENGTPVKTASLLDLYSGCGGMSTGLCLGSALAGLKLETVRNEKAEDFLALLKEWAILCDKYVHSNDSDAADPVEEEEDDEPLGKDEFVVEKLLEICYGGTGRKNGIYFKVQWKGYGPEEDTWEPIENLSDCPLKIKEFVQEGYRRNILPQPGQVDVICGGPPCQGISGFNRFRNRDNPLEDEKNQQMVTYMDIVSYLQPKFVLMENVVDILKFADGYLGRYALSRLVSLNYQARLGMMVAGCYGLPQFRMRVFLWGALPTMVLPKYPLPTHDVVVRGGAPNAFSQSIVAYDETQRPTLKKALLLGDAISDLPKASAFFPCFISSSSTFVLTSIIMQVDNCQPHEVIEYGGQPKTDFQRYIRLSRKDMLDYSFGDATCPEEGKLLDHQPLRLNQDDYDRVQQIPIKKGANFRDLPGVKVGANNIVEWDPDVERVYLKSGKPLVPDYAMSFIKGRSPKPFGRLWWDETVPTVVTRAEPHNQIILHPNQGRVLTVRENARLQGFPDYYRMYGPMKEKYIQVGNAVAVPVARALGYSLGRAYQGEVDAGYDALFVLPDSFTNIGQTGARARASSVGTPAGEVVEQ

SEQ ID NO: 987 - protein, 870 aa, Triticum aestivum
MDRSPAPLSPPGFAVPLAVKKRQQAAPGYSSSSSPWGVPPAPPLTNNNNPNPPNGLRAGDTSIFSTSLPVLPHEKLNFPDSAHGTPSMDDASAKLKDFDDDPQGNDYPFDFDLRQIDDLLPDEDELFAGITNEMEPSSQANPVEELEEFDVFGSGGGMELDSDPLDSITAGLGNASISDGIRANGVNNNFGLSNSPGAVAGEHPLGEHPSRTLFVRNINSNVEDSELRSLFEQFGDIRTLYTATKHRGFVMISYFDIRAARGAMRSLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRSLVQHLGHELEDETRGYRHSPHVGSPMANSPPGAWAQYGSPTDNNLLHAFSNSPTGNGMSPIGMSPSMMSNALKIAPIGKDNNWSKYDQVFSNSNQSLGAAFQYSQSYQDRKSEHMSSSPGTLTGPEFLWGSPKPYPEHSQSSSMWRPPPVGHAMSSSSRPQGQGFLYGSRQASLFGSLDQNRHHVGSAPSGAPFESHFGFLPESPETSFMNQVRFANMGNIGGANRNGGSLMLNMASRASLNPVSALSGSLTDNNSTNFRPIPSPRLGQPPFFGNTTYQGPGYYGLDSSSIERGRNRRVDSSAFQADSKKHYQLDLDKIRKGEDTRTTLMIKNIPNKYTSKMLLAAIDELHKGTYDFFYLPIDFKNKCNVGYAFINMISPVHIVSFYQAFNGKKWEKFNSEKVASLAYGRIQGRNALISHFQNSSLMNEDKRCRPILFHSNGPETGNQEPFPNGICIHMPLDGGAGSSKEPLGFEEDDNPSEIKISGEKSMAGSL

SEQ ID NO: 988 - protein, 1625 aa, Triticum urartu
MATVPSVTAPAPIWAISAVFPPVYHTHLFGCASWGLSLLGVRRLFSEIRWSTCILSGSVLGGIEIHRKSSVALICLDCLQLVIFVLEYPRDISNMVKSPRSPVTTGTKRCRAKPQKKGEEFTAQGKLVDGPQDATNGVEKGAGSATHKRPRRAAACSDFKEKSVRLSEKTSVVKIKKNRMEEEEIDAINLTKLGPEDSPPCRKLIDFILHDADGNLQPFEMSEIDDFFITALIMPMDDDLEKERERGVRCEGFGRIEDWAISGYDEGTAVVWLSTELADYECVKPASNYKSYYNHFYEKAQVCVEVYRKLMRSVGGNPNMSLEELLASVVRSVNAIQGYTGTMSKEFMIATGEFVYNQLIGLDQTAGNDDEKLVTLPVLLALRDECKSRAEFTKMPLSISNGSLKIKDIECKEVAEDDDEKLARLLHEEEEWKMMKKQRGNRGVPSQKNVYIKISEAEIANDYPLPAYYKPSSQEMDEYIFDSEDGMFSGDVPVRILNNWALYNADSRLISLELIPMKSGAENDIVVFGSGFMREDDGSCCSTAESAKLSSSSSKADNQDVGVPIYLSPIKEWVIEFGGSMVCITIRTDVAWYKLRQPIKQYAPWCEPVLKTARLAVSIITLLKEQSRASKLSFADVIKKVAEFDKENPAFISSNIVLVERYIVVHGQIILQQFADFPDETIRRSAFATGLLMKMEQRRHTKLFMKKKAQVTRGENLNPIATMGTSSKRKAMRATTTRLINRIWSDYYAHHFPEDLKEGDGNEAKEVDDEQEENEDDDAEEEVQIEEDKVAKTPPSTRSRKLVSQTSKEMRWKGDPAGKTTSGEALYKCAYARELRIDVGGAVTLEDDSGEIVICFVEYMFQKSDGAKMVHGRILQKGSETVLGNAANERDIFLTNDCLEFELKDIKELVSVNLQSMPWGHKYRKENSEAEKIEWAKVEERKKKGLPMEYLCRSLYWPEKGAFFSLPRDKLGLGNGVCGSCEHREPDCDELRILTKTSFIYRKVTYSVHDFLYIRPEFFSQEEDRGTYKAGRNIGLKPYAVCHLLDVCGPAGSKKVDPASTKVSVRRFYRPDDISTAKAYTSDIREVYYSEDIINVPVDMVEGKCEVRKKIDISNSDLPVMIEHVFFCEHFYDCATGALKQLPSNVKLMSVARKATGALKKNKGKQICENNEVDSGKWMEVPKESRIATLDIFAGCGGLSEGLQQAGVSFTKWAIEYEEPAGEAFRQNHPEAAVFVDNCNVILKAIMDKCGDSDDCVSTSEAAEQAAKLAEENIKNLPVPGEVEFINGGPPCQGFSGMNRFNQSPWSKVQCEMILAFLSFAEYFRPRFFLLENVRNFVSFNKGQTFRLAVASLLEMGYQVRFGILEAGTFGVAQSRKRAFIWAAAPGEILPDWPEPMHVFASPELKITLPDGKYYAAAKSTAGGAPFRAITVRDTIGDLPKVENGASKLVLEYGGEPTSWFQKKIRGSTIALNDHISKEMNELNLIRCKHIPKRPGCDWHDLPDEKVKLSSGQMVDLIPWCLPNTAKRHNQWKGLYGRLDWEGNFPTSVTDPQPMGKVGMCFHPDQDRIITVRECARSQGFPDSYQFSGTIQSKHRQIGNAVPPPLAFALGRKLKEAVDGKHQQA

SEQ ID NO: 989 - protein, 683 aa, Triticum aestivum
MIDQYKHQQLQIGLVSPQQIKAWANKNLPNGEVVGEVTRPSTFHYKTDKPEKDGLFCERIFGPIKSGICACGNSRASGAENEDERFCQKCGVEFVDSRIRRYQMGYIKLACPVTHVWYLKGLPSYIANLLDKPLKKLEGLVYGDFSFARPSTKKPTFLRLRGLFEEEIASCNHSISPFFSTPGFATFRNREIATGAGAIREQLADLDLRIIIENSLVEWKELEDEGYSGDEWEDRKRRIRKVFLIRRMQLAKHFIQTNVEPEWMVLCLLPVLPPELRPIVYRSGDKVVTSDINELYKRVIRRNNNLAYLLKRSELAPADLVMCQEKLVQEAVDTLLDSGSRGQPTRDGHNKVYKSLSDVIEGKEGRFRETLLGKRVDYSGRSVIVVGPSLSLHQCGLPLEIAIKLFQLFVIRDLITKRATSNVRIAKRKIWEKEPIVWEILQEVMRGHPVLLNRAPTLHRLGIQAFQPTLVEGRTISLHPLVCKGFNADFDGDQMAVHLPLSLEAQAEARLLMFSHMNLLSPAIGDPICVPTQDMLIGLYVLTIGKRRGICANRYNSCRNYPNLKVNYNNNNNSKYRKDKEPHFSSSYDALGAYRQKLISLDSPLWLRWNLDQRVIGSREVPIEVQYESLGTYHEIYAHYLIMGNRKKEIRSIYIRTTLGHISFYREIEEAIQGFSQAYSYTT

SEQ ID NO: 990 - protein, 1402 aa, Triticum urartu
MEQACRGGERRFINAHFRVLTCDTDTRAKNTEFKRHNVDDLMMEEPNAEMGMPTGELKGITFYLMTNTEMEKSSSVSIVEPSDVSSAKLGLPNGAPQCETCGAQSVRECDGHSGVIKLPATVFNPHLFEEVVQLLNQICPGCHTPKQNRDSKRSDGATSQATCKYCSKDGTKQYPDVIFKTLTSPRMTLSKAKLQRDPSVMDKISLTAEVADRVTDSAEVLPLDYWDFVPHHHPPQSNMTKILLSPYQASHILKQLDPELFSRFASRPELIFLSCLPVTPNFHRVAELPYGFSDGPRLAYLHSKKTDKESSTDTHGMKWLKDAILSKRSDNAFRGTMVGDPKIRLHEIGIPVDLASNLLVSEHVNSYNFDSINSKCNCYLLANEKLVIKRSGKTIIVRKPNQLVIGDTVHRLLQDGDLILINRPPSIHQHSVIGLSAKLLPVQSVLSINPLCCAPLAGDFDGDCLHGYVPQSIQSRVELEELVSLSHQLLNAQDGRSLVSLTHDSLAAAYLLTSSEVLLKKTEVQQFQMLLCHPLSPTPGPAIMKSIHSHGPLWTGKQLFSMLLPSDMSFSIEPKNSISGLFSVMFKQYGDKALELLSSAQDVLCEFLTMRGLSVSLSDIYLFPDHDSRRKLADGVNLALDDAEEAFRIKQILLSPDSISILKCYDDCADLSQSYEQSNFIQSNLPIIKSSIMAFKSVFSDLQKMVQQHTAKNNSMMMMTNAGSKGSMLKFVQQTACVGLQLPASRFPFRIPSELSCASWNRHKSEGTGECLGGQNLYAVIRNSFAGGLNPLECLLHSISGRANFFSENADVPGTLTRKLMYHLRDLYVAYDGTVRSSYGQQIMQFTYDTAEDMCSDRNVEGELGAPVGSWAACSISEAAYGALDHPVNSLEESPLMNLQDVLKCQKGGTSMDHVGLLFLSKNLKKYRYGLEYASLEVKDHLEPVNFSDLVDTVMILYGGCGIESTKGSAWITHFHLSQEMMTKKRLGLTLVVEELTEQYNAKRDKLNFPKVYISKGVNTAGKMVRRLFGRGIRLGIARMSKCSADNECGNRQTCCITVVTQDDSNSMSQLDTIKKRVIPNLLALLVKGFLEFKKVEIQCQEDSELVVKVVMSEEHCKSVKFWATLQKSCIAIMELIDWERSRPGSVYDIFCSYGIDSAWKYFVESLRSKTDDIGRNIRREHLLVVANCLSRPAHTFINAAKQSSVDNLCGTVDAMAWGKEPSTGTSGPFKIIYSGKAHAPIPNENIYDFLNSPEVRQAPGEAFLNGSTISVEQDFLVAAVGIWDSIIDMRTCLQNMLREYQLNECVGELDKSRVIEALRFHPRGREKIGAGIEDIKIGHHPSHPGTRCFIMVKAYVRIQNDDGGTLDAIPLFGASYLETWLGGSKLRSYGARCCYGPFSRV

SEQ ID NO: 991 - protein, 1402 aa, Triticum urartu; identical to SEQ ID NO: 990

SEQ ID NO: 992 - protein, 1076 aa, Triticum aestivum
MLRNGNEGMSTIPGFSQIQFEGFCRFINQALAEELDKFPTIKDPDHEIAFQLFAKGYQLLEPSIKERDAVYESLTYSSELYVSARLIFGFDVQKQTISIGNIPIMNSLGTFIINGIYRIVINQILLSPGIYYRSELDHKGISIYTGTIISDWGGRSELAIDKKERIWARVSRKQKISILVLSSAMGSNLREILDNVSYPEIFLSFPNAKEKKRIESKEKAILEFYQQFACVGGDLVFSESLCEELQKKFFQQKCELGRIGRRNMNRRLNLDIPQNNTFLLPRDVLAATDHLIGMKFGTGILDDDDMNHLKNKRIRSVADLLQDQFGLALGRLQHAVQKTIRRVFIRQSKPTPQTLVTPTSTSILLITTYETFFGTYPLSQVFDQTNPLTQTVHGRKVSCLGPGGLTGRTASFRSRDIHPSHYGRICPIDTSEGINVGLTGSLAIHARIDHLWGSIESPFYEISAEKAKEKKERQVVYLSPNRDEYYMIAAGNSLSLNQGIQEEQVVPARYRQEFLTIAWEQIHVRSIFPFQYFSIGGSLIPFIEHNDANRALMSSNMQRQAVPLSRSEKCIVGTGLERQTALDSRVSIIAEREGKIISTDSHKILLSSSGKTISIPLVNHRRSNKNTCMHQKPRVPRGKSIKKGQILAEGAATVGGELALGKNVLVAYMPWEGYNFEDAVLISERLVYEDIYTSFHIRKYEIQTDTTSQGSAEKITKEIPHLEEHLLRNLDRNGVVRLGSWVETGDILVGKLTPQIASESSYIAEAGLLRAIFGLEVSTSKETSLKLPIGGRGRVIDVKWIQRDPLDIMVRVYILQKREIKVGDKVAGRHGNKGIISKILPRQDMPYLQDGTPVDMVFNPLGVPSRMNVGQIFESSLGLAGDLLKKHYRIAPFDERYEQEASRKLVFSELYEASKETKNPWVFEPEYPGKSRIFDGRTGDPFEQPVLIGKSYILKLIHQVDEKIHGRSTGPYSLVTQQPVRGRAKQGGQRVGEMEVWALEGFGVAHILQEILTYKSDHLIARQEILNATIWGKRIPNHEDPPESFRVLVRELRSLALELNHFLVSEKNFQVNREEV

SEQ ID NO: 993 - protein, 1120 aa, Triticum urartu
MEMALCHVSPIQLGAPAVNLPPMGSSVERGLDSEIILNKGQIRLNFSKKAGRWAAQALLGAAFVCLFRHANAVPWQVRSDYQAQTRVFFFFVVPFDEVMSLSEEGGGTTDKMGKQDNDVSRAVVEDDTALLLAAVDSIKKAALGRLRNGSDAARILDQDMSNRLLHLACRHDAAECARLLLDGEYGITPASVDARDPLTRTPLHVAAEGHSKRCIQLLLSRNARTDVRLLDGTRLVALEVALMSRRVQVDWSQDNSVEDLLAYLQQKDLNAVRLLAEKTREVGEVAYRYAMEGRVAALAMLLLVTEERISAMVSVVIDGVRTKRSIYNSVVDEVLSIGEASAREGNEMRRKALLCEIQLLNQFGATVWRDRKVDRRSLPPLLRAAKAGDMNVTKMLLMGDVDVNETDPEGNTALHWCLSSSSSTQEPRIVWLLQKNGARVFQGNKLGLTPVHSAAAKGNYKALQSLLLHAQDCVDIPSKTKETPLFLAVKNGSLSCVRLLLRYGANPKAQNLRKQRPIDVATSQDMRFLLNSANVVPMNHGSMEKNHAMKKERHKELLDDDFDDCDNDDYYESYVVPKASVGHRDFRVKSKGHSTPKEGPKLSRHNDHWEKHDYTRKIFVGGLPLSVDDAYLSKFFSTEFGPVEEAIVITLKIDERIQSRGFGFVKFKREKDMISAKEAHHVYVLGKRVEIKDAVARPSLPELERATSFRHHVRESPRVTHSELEDEQAEQYNFGKRRPMPEKHLPSWFFIFRRWLPGFLMEATERYGEKYPLCSVKTDFRSCCRMELDHSALGYPKLSDFMRSLPGICRMRVVPVGNGPATHMVLLPPLSRPKYVPLLEPYSFDHDELPESVSDHHSPRSPLTANITENAPYSTDSPQGDACSETNVQSQHDDECSRSNGESLPDGDSTSNCSLLDEVTVSTPKSDLIESPARKPDLIVSGALPGKAEQGPLRRPDLVESAPTKKLDLIESSPPPSPPSKADLVQPGPAGKLHLVESSPPRKAELVEPGPARKIDLNQPRPTTRFVDRPVERPAITPSSCENEMRFSFFHSQWDKYLTPHAKSDYCIICRSCEAAMELVPCLHKICVACMMRCNVRACMTCGTAGVMECVSDQKCQLMV

SEQ ID NO: 994 - protein, 1089 aa, Triticum urartu
MATAVSAPVFTATVRVSNIPPSAVAKELLAFFDSAVAAAGEAYACEIAAARRGCVRVEVIPGKRRIDLYLNHDSQRYRLEVYFEDIRNCLQCSFDGAGVILLQDLSEGVTPLKIRLFLSVQIDHAAVVNTSMITVLVLNVQRLQQLMYAPRICTTISGPAVYSRFSDDRFHACKEDAKFTWVRALDFTRNHSFGKCSTLALVLDEGAPVSFILNSLPMSGELGELVISSMEFFGPSSKVVPLVDCPSGCSVSYEVLFRLNSLVHMGKIVSKDVNADLFKALEEIPVHISRRIFEKMNKLDFTCYEPLQFIQQEAHSRKRSHDGLLSSKTEGEGKLMMCYRIHITPSKIYCLGPEEEVSNYVVKHHKQYASDFARVTFVDEDWSKLFPDAISARTGRGFFSHPLKTGLYHRILSILKEGFSIGPKKYEFLAFSASQLRGSSVWMFASNDSLKAEDISRWMGNFEDIRSVSKCAARMGQLFSSSRQTLEILPRDVEEIPDIEVITDGSKYIFSDGIGKISERLAKEMACRIGLDYTNPPSAFQIRYGGYKGVVAVDPDSFRNLSLRPSMKKFESKSRMFNITSTSKSQPCYMNREVISLLSTLGIRDEIFESMQQNDMRELDEMLTNREAALSVLGKIGSAETKTASKILLQGYEPSLEPYLLMILKAHQDNRLTDIRTRCKIHVPKGRVLIGCLDETGELEYGQVYIRITKNSKEQKDNCQPYFAEDNGKEKTAVVVGKVAVSKNPCLHPGDIRVLEAVYDHGLYAKNLVDCVVFPQRGERPHPNECSGGDLDGDLYFITWDEKLIPEKVDSPMDYTAARPRIMDHVVTLEEIQKYFVDYMINDSLGAISTAHLVHADRHPMKARSPECLQLAALHSMAVDFAKTGAPAEMPRSLRAKEYPDFMERWDKPTYISNGALGKLYRAAASRMQSAPAPSSSAQSSPAFDPDLEVPGLEEFLASAEEFYDLYAEKLSTLMSYYGAEHEDEILTGNIRNRLLYLKKDNKRYFEMKDRIIDSVEGLHKEVQGWFRSRPKAEASRWASAWYRVTYHPEHRRPGKKQFWSFPWIVCDELLKIKESSMRRRQQVDDAAA

SEQ ID NO: 995 - protein, 107 aa, Triticum aestivum
PHPNECSGSDLDGDIYFVSWDPDLIPTRMVAPMDYTPAPTETLDHDVMIEEVHEYFTNYIVNESLGIIANAHVVFADREILKAESTPCIKLAELFSIAVDFPKTGVP

SEQ ID NO: 996 - protein, 648 aa, Triticum aestivum
MESSRGILIPGTPPLPYAYEPLPSSSADANGQEDRRITGGVRWRAWAAVLAVGALVVAAAVFGASRVDRDAVASSVPATAEHGVLEKASGPYSASGGFPWSNAMLQWQRTGYHFQPEKNYQNDPNGPVYYKGWYHFFYQHNPGGTGWGNISWGHAVSRDMVHWRHLPLAMVPEHWYDIEGVLTGSITVLPDSRVILLYTGNTETFAQVTCLAEAADPSDPLLREWVKHPANPVVYPPPGIGMKDYRDPTTAWFDNSDNTWRIIIGSKNDTDHSGIVFTYKTKDFVSYEMIPGYLYRGPAGTGMYECIDLYAVGGGRKASDMYNSTAKDVLYVLKESSDDDRRDYYALGRFDAAANTWTPIDTEQELGVALRYDYGRYDASKSFYDPVKQRRIVWGYVVETDSWSADAAKGWANLQSIPRTVELDEKTRTNLIQWPVEELDTLRINTTDFSGITVGAGSVVSLPLHQTSQLDIEASFRINASAIEALNEVDVGYNCTLTSGAATRGALGPFGILVLANVALTERTAVYFYVSKGLDGGLRTHFCHDELRSTHATDVAKEVVGSTVPVLDGEDFSVRVLVDHSIVQSFVMGGRMTATSRAYPTEAIYAAAGVYLFNNATGASITAEKLVVHDMDSSYNRIFTDEDLLVLD

SEQ ID NO: 997 - protein, 304 aa, Triticum aestivum
MGNQELLEYFSDYAATKARHAYGPGGHRGMSVLIFESSAVGYMEAERLHKHFIDQRTDRDTWQNRRVPFLPGGKRQLYGFLARKEDMETFNRHCQGKSRLKYEMRSHNEMVVAQMKQMSEDNQQLNYLKNKVVKTEQRSKVVEETLGVITQKLRETMEENIFVRSKAKEKHSEYEEEMKSQEKFFHDQIENIHKATEDKESEFERLLQEERAKARQCDVDSGTTENRRLRKEQVQRFIECQVKDVQEFEAERDEMIKAHEEKKVQLKKEYMAKEVELEKEFDAALTGLMEKHRPGTFQASSSSP

SEQ ID NO: 998 - protein, 745 aa, Triticum aestivum
MDRTSNFMPTPDQDVLDIQPLRTLAPMFPAPLGVNTFNVPNTTPPLIFVTSAGQFPGGVGAPGHPAFRSFAAAFGAQDAYGGQPASSGGQHDGGGHPASSRRQDGGGGQATTFADKYAANGGQTAANGATNLGASADSPIDVIPISAYRPTPPPVIPLDDDDDDNEHFTGNQTSASGRKIKRPSHLSGYKMSGGLGSDDNNGVKTKRNKTSHRKAGADNEFTSVPLSSSNPREAVEEVLMNFEALRRRHLQLDAAQESTKRPDLKIGAVMMANNLRANIRKRIGVVPGVEIGDIFYFRMELCIIGLHAPTMAGIDYMTHTFGDKDDDSVAVCIVAAGVYENEDDATDTLVYSGSGGSSKNNEEMHDQKLERGNLALQMSLSRKNVIRVVRGFKDPGSLGGKVYMYDGLYKIHESWKERTKTGINCFKYKLLREPGQPEGMSIWKMSRKWVENPATRGRVLHPDLSSGTENLPVCLVNDVDSEKGPGLFTYITQVKYPKPLSSMKPLQGCSCLNACLPSDTDCDCAEFNGGNLPYSSTGLLVCRKNRLYECGESCQCSVNCRNRVTQKGIRVHFEIFRTGNRGWGLRSWDPIRAGSFICEYVGEVIDESKRNLDGEDEDDYLFQTVRPGEKTLKWDYVPELMGEQITNNSADTFEPLPIKISAKKMGNISRFMNHSCSPNAFWQPVQFDHGDDGHPHIMFFALKHIPPMTELTYDYGEIGADSGGIGSPGAKRCLCGSSNCRGYFC

SEQ ID NO: 999 - protein, 1252 aa, Triticum urartu
MGGKTIQVSGFPSTVNADHVKDLLEKIVGTGNVFAIKLRPPKNISANSKSFAIVQFQSEAHASLVLNAARRNALRSGSNHLKARYAERDIVPRPRTTIFNLQDATLHFGCLLREKVLSVLWSGTNVSVEFGFAMKRIDFCLIYNSKKYKLELSYESIWEIQLHRPPGLQKKFLLIQLFLFIESSEIFVNLSWRNVSVSQVQAAPKIYEQNIRRSGSMYDDPLFNYSRDDTDDQWTRTTDFTPSASIGQSYILCLELPHICYLPNIREYFVYYEVHDDVFHLQRGHSYSSNTCFVPVVKSHHFTDVPYEILFKINHLVQNGTLSGPTLDDNFYRLVSPGYECIDHIKRALEKMSYLKKTCLNPTKWLSEQYKKNRRSRYMLKSPNITLDDDGLVYVYRVQITPAKVYFYGPEINVSNRVVRHYAADLDNFLRISFVDEDCEKLRSTDLSQRSAPGNNTRRTALYNRVLSVLSNGITIGDKHFDFLAFSSSQLRDNSAWMFASRTGLSASDIREWMGDFRNIRNVAKYAARLGQSFSSSTETLKVHKYEVKEAPDVTNGTKYVFSDGIGTISADFADEVSKKCNLTCFTPSAFQIRYGGYKGVVAIDPTSRWKLSLRKSMSKFQSENITLDVLAYSKYQPCFLNRQLITLLSTLGVRDSIFELKQQEAVKQLNRMVAEPQAAIDAIELMPMGEVTNVVKELLLCGYQPDLEPYVSMLLQTFRASKLLELKTRSRIFVPKGRAMMGCLDETRTLEYGQVFIQVSNSADNRGKSIVTGKVVVAKNPCIHPGDIRILQAVQSPLLGHMVNCVVFPQLGPRQVFSNAFFYVFQPHPNECSGSDLDGDIYFVSWDPDLIPTRMVAPMDYTPAPTETLDHDVMIEEVHEYFTNYIVNESLGIIANAHVVFADREILKAESTPCIKLAELFSIAVDYPKTGVPAQIPPELHVKEYPDFMEKLDRATYVSKGVIGKLYREIKKQNPHIGHFTKDVARRSYDTDLIVDGYQDYITEAVWFKEQYDFKLGNLMEHYGINSEAEIISGCILKIANNFTKKNDADAIRLAVKSLRKEARSWFCEMGSDESGGGHEASDAKASAWYHVTYHPEYWGCYNEGYDHRPHFISFPCLDDEEWEVRFHFLDRDNLERTICLSDITFWNLIALIEVEGYSSRDFMYYVRDPGAAVSGMEELTDDDKVEEMLDHIASKGKNVVNITVMRSDAPRPVDLNIGHAYEEQVPLSEIRVPVVYEVDNSGVLFPSPVK

SEQ ID NO: 1000 - protein, 169 aa, Triticum aestivum
MASNQNQASYAAGETKARTEEKTGQMMDKAGQATEATKQKAGEAKDKTAQTAQAAKDRAAESKDQTGSFLGEKTEAAKQKTAEATDAAKQKASETAQYAQERSSDAAQYTKESAVAGKDKTGSVLQQAGETVVSAVVGAKDAVANTLGMGGDNTNTAKDSTTEKITRDH

SEQ ID NO: 1001 - protein, 947 aa, Triticum urartu
MGGKTLQVSGFPATVNADHVKDLLERIVGVDNVCVVKLRPPKNNSANSRSFAIVQFQTEAHASLVVNAARGNALRSGSNYLKKYRLELSYESIWEIQLHDPPGSQKKFLLIQVLAAPKIYEQNLQHSGSMYDDPLFNYFRDDTDDQWTRTTDFTPLASIGQSYILCLELPHDCDLPNIQEYFVYYKEHKRDFHCHRGHSYSSNTCFAPIVKSLYFTDIPYEILFKINHMVQNGTLSGPTLDDNFYRLDCEKLRSTDLSPRSAPGNNARRTALYNRILSVLSNGITIGNKHFEFLAFSSSQLRDNSAWMFASRPGLSASDIREWMGNFRNIRNVAKYAARLGQSFSASTETLKVHKYEVHVIPDIKNGTKYVFSDGIGTISADFADEVSKKCKLARFTPSAFQIRYGGYKGVVAIDPTSHWKLSLRGSMSKFPSDNITLDVLAYSKYQPCFLNRQLITLLSTLGVRDNIFELKQQEVVKQLNRMVTEPQAAIDAIELMPMGEITNVVKELLLCGYKPDVEPYLSMILQTFRASKLLELKTKSRIFIPEGRAMMGCLDETHTLKYGEVFIQASNSANDSDKFVVTGKVVVAKNPCLHPGDIRILEAVYTPVLDHMVNCVVFPQQGPRQQNLISVNMFLFGTRNQQWKIKQEVHEYFANYIVNESLGIIANAHVVFADRESLKAESTPCIKLAELFSVAVDYPKTGVPAQIPGELHVREYPDFMEKLDRVTYVSEGVIGKLYREIKKQSPHIGHFTKDVARRSYDSDLIVDGYQDYIDEAVWMKGEYDFKLGNLMEHYGIKSEAEIISGCILKMAKNFTKSSDADAIRQAVKSLRKEARSWFSEMNASESGDVPEALYAKASAWYHVTYHPEYWGCYNEVYGRPHLISFPCAWCIEMNGGSKFRDCETADNWWSGSEEKSTETTNSDSTDMVSGVLNMLQKVVSLRNAMP

SEQ ID NO: 1002 - protein, 1512 aa, Triticum urartu
MASEPEEGLHFLQSKMVPVNVCQDLGLYWSDKEWGRLLPMTCLSALPATSRMDSQLVELCISRCGEWLVSSVAYSLQCGSNKLNYTKCINSLEELLHAKVCSVDNAELESVLAFPDMEVYTYVPLSHSNLTVTYNKELDRSKLESERILRESLYDFKDSQKKLKSLGRLHGNLVFCLQELGSFGALQAAKAFLSSDGDVLDRKESDMNDNSTRFKHHYLNKAISVLNCNILDALHESDKTCFLGTHDDSFHLEMLEEPFFSNKIVVLIKILSRYRLEENMKCIVFVKRITVARAIAHILQNLKGLDLWKCEFLVGRHSGPKNMSRQKMDAIVENFSSGEVNLLIATSVGEEGLDIQTCCLVVRFDLPETVASFIQSRGRARMTNSKYVVLLERGNHSQEKLLNDYIDGEGIMNGEIDLRTSNDVFDHLEEKSYRVEKTGASISTACSVSLLHRYCYNLPKDMFFNPSPAFIYIDDTEGIICRVILPPNAAFRQVDGQPCQSNDEAKRDACLEAYVKLYELGALTDFLLPGSGSGKNRASTTNGSASNSHDDESLREELHEMLIPTILKPSTCKLDCPLNLHFYYIQFFPIPADRHYRIFGLFVINSLPMEAEKLEVDLHLARGRIVKAGKKQFGAMMLARNFQEMFLKVLLDRSEFTVSHVMLLGNSETLQFNSTFYLLLPIKQELYGDIFMIDWQTVKRCLSSPVFKDPTGVSAHGSYLPDESLRLLDNMYSKTDVVGSLIFAPHIKTFFVIDVILNELNARSEYDGATYEDHYKERFGIKLSHPEQPLLHAKQLCNLHNLLHDRLRETTEEGRELMEHFVELPPELCSLKIIGFSKDMCSSLSLLPSLMCRLENLLVAIELKDVMLSSFSEASQISASGILEALTTERCLERISLERFEVLGDAFLKYVVGRHNFLTYEGLDEGQLTSRRSAIVNNSHLYELSIKRNLQVYIRDQHFEPTQFIALGRPCKVVCNADTEVNIHTDSRENCNLRCTKSHHWLHRKTIADAVESLVGAFLVEGGFKAAFAFLHWVGIDVDFKDSSLYRVLDASSINLSLTNHTDVGELEELIGYNFKHKGLILEAFVHPSFNKHSGGCYQKLEFLGDAVLEYLITSYLYSAYPDLKPGQITDLKSLAVSNNSLAYVAVQKGIHKYLIKDSNYLSSAVNKFENYIRLPNSEKDLVEEPACPKVLGDIVESCVAAVLLDSGFNLNYVWTLVLMLLKPVLSFSDMHMNPMREIRELCQSHELELGLPEPMKADGEYHVKVEVNINSQVISSAAANRNSKVARKFAAQETLSKLKNYGYTHKNKSLEEILRDARKKEPELLGYNEEPIKVEADISAETNNLKIGKERDANISFQNTAISIRGTLRTSSQRTAGNTMFSKDDVSIERNNQLKVAKQNACLPKGTTQKNIRKEYHGDMVNKTAKSFLFEVCAVSYWIPPEFELCKEEGPSHLRRFTYKVTVQIRGPSETLLECYSDAQLQKKAAQEHAAQGALWYLRQHGYLPKDEVRV

SEQ ID NO: 1003 - protein, 814 aa, Triticum aestivum
MSGTAAPRYAPDDPTVPKPWRGLVDGTTGYLYYWNPDTNVTQYEKPVPPEAQLPPPPPLPPPPPRARGRDRRDRSRSRSRSRSRTPPRREHRDRDRDRDRRRHDEHDSFKPSSSHHHLPPAATIIPTAAADDPSAEAYRRRHEITVIGDNVPAPITEFDSGVIPLDILKEIQRAGFPSPTPIQAQSWPIALLNQDVVAIAKTGSGKTLGYLLPGFMHIKRMQNSTRSGPTVLVLAPTRELATQILEEAVKFGRSSRISSTCLYGGAPKGPQLRDLERGVDVVVATPGRLNDILEMRKISLKQVSYLVLDEADRMLDMGFEPQIRKIVRDIPSGRQTLMYTATWPKEVRRIADELLVHPVQVTIGSVDELVANKAITQHVEVVTPSEKLWRLEQILRSHDSGSKILIFCTTKRMCDQLSRTLNRQFGAAAIHGDKSQNEREKVLSQFRSGRSPILVATDVAARGLDIKDIRVVINYDFPTGVEDYVHRIGRTGRAGATGLAYTFLCDQDSKYAADLIKILEGADQDVPPELLDMVSRGGRGRKRNKWATRSERGGGSRPELDSRYGGRLEGSRGGRGKDDYGGRSRNDHGGSRRSARGRSRSLSRSDSDRRSPSPKRRRHDVQSSRSRTRSRSRSRSRSRSRSRNKSRNRSRSRSYTRNRRASRSRSRSPGARRRPERRAGSGSTRPDSAHPVEKKSSPNAHPSNDHRSRSVDPSNDYQAEDGKMGKVDLDRSPSPQEQDDKSAPYSSVYNGEGGRGSMSPNGEPVVDAKPVEVSVSSKKREDEEEGMIDEEGEEGMIADDDPRASAAVQNGGDK

SEQ ID NO: 1004 - protein, 779 aa, Triticum urartu
MIVRANHFLVGFADKDICHYDVAITPEPKTRRINRVLMTELTSKHRVSSLGGLLVAYDGSKSLYTAGELPFQAMDFSIKLGKPPRETYVTVSRSFYSTIFGQRDIGDGLECWRGYYQSLRPTQMGLSLNIDISSTPFYKPISVMQFVQECLNLRNPDPNRPLSDRDRLKLRKALRGIRVETTHQEGKRSAYKITGITSVPLIQLNFPLDEGNQMTVVQYFWGRYKYRLRFTSWPCLQSGNDSRPIYLPMEVCKIIEGQRFTRKLNEKQVTGILRATCERPRDRENSILKMVEHNNYSADKLAQEFGIDVTDKMLKYHESGKDKACAPSVGQWNMIGKKMINGGNVQRWTCLNFSRLHIDGVKRFCGDLVKMCNAIGMVFNPMPVVEILSASANNIEGALKDAHQSARDLQLLIVILPDVTGHYGKVKKVCETDLGIVSQCLKPDKVERANKQYFENVALKVNVKVGGRNTALQQALTRQIPLVTDQPTIFFGADVTHPAAGDDSSPSIAAVVASMDWPEITKYKAVVSAQPPRQEIIQDLYCTGIDPEKGTPVHSGMMRELLVSFFQKTKHKPSRIIFYRDGVSEGQFAQVLMYEMDAIRKACASLQEDYQPPVTFVVVQKRHHTRLFPEVHGKETDKSGNILPGTVVDTNICHPTEFDFYLCSHAGIQGTSRPTHYHVLFDENRFTADGLQLLTNNLCYTYARCTRSVSVVPPAYYAHLAAFRARYYDEPSEGSDSASIVSGGTRESAATGAGAAGPPGTYRRLPRIRDNVKDVMFYC

SEQ ID NO: 1005 - protein, 916 aa, Triticum aestivum
MESHSDDLPPPPPLPPNAEPIKAESADDLPPPPPLPPIKPEEAKKISKPKRALIARPGFGKRGNPIQLVTNHFKVSLKTTDEFFHHYYVNLKYEDDRPVDGKGVGRKVIDKLAQTYPSELAHKDFAYDGEKSLFTIGALPQINNEFVVVLEDVSSGKTPANGSPGNDSPDKKRVKRPYQTKTFKVELSFAARIPMSAIAMALKGQESEHTQEAVRVIDIILRQHSSKQGCLLVRQSLFHNNPSNFVDLGGGVMGCRGFHSSFRATQSGLSLNIDVSTTMIVKPGPVVDFLLANQKVDHPNKIDWAKAKRALKNLRIKTSPANTEYKIVGLSERNCYEQMFSLKQRNGGNGDPEAIEISVYDYFVKNRGIELRYSGDFPCINVGKPRRPTYFPIELCQLVPLQRYTKSLSTLQRPSLVEKSRQKPQERMSVLSDVLKRSSYDTEPMLKACGISIAQGFTQVAGRVLQAPKLKAGNGEDIFTRNGRWNFNNKRLARACVVDRWAVVNFSARCNTMNLVNDLIKCGGMKGNTVEKPHIVIEENGSMRRAPAPKRVEDMFEQVKSKLPGAPKFLLCILAERKNSDVYGPWKRKCLADFGFVTQCVAPTRVNDQYLTNVLLKINAKLGGMNSLQQIEMSPSIPLVSKVPTLILGMDVSHGSPGQSDIPSIAAVVGSREWPLVSKYRASVRSQSPKLEMIDSLFKPQGTDDDGLVRECLIDFYTSSGKRKPDQIIIFRDGVSESQFNQVLNIELDQIIEACKFLDENWNPKFTLIVAQKNHHTKFFIPGSPDNVPPGTVVDNAVCHPRNYDFYMCAHAGMIGTTRPTHYHILHDEIHFAADDLQDLVHSLSYVYQRSTTAISVVSPICYAHLAAAQVAQFIKFDEMSETSSSQGGGHTSAGSAPVQELPRPHEKVRSSMFFC

SEQ ID NO: 1006 - DNA, 11405 bp, Artificial sequence
  vector
  misc_feature (3153)..(3153): n is a, c, g, or t
  misc_feature (3366)..(3366): n is a, c, g, or t
tggcaggatatattgtggtgtaaacaaattgacgcttagacaacttaataacacattgcggacgtttttaatgtactgaattaacgccgaattaattcgagctcggatctgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaagattctgcagttagatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatcgattcgatttggtgtatcgagattggttatgaaattcagatgctagtgtaatgtattggtaatttgggaagatataataggaagcaaggctatttatccatttctgaaaaggcgaaatggcgtcaccgcgagcgtcacgcgcattccgttcttgctgtaaagcgttgtttggtacacttttgactagcgaggcttggcgtgtcagcgtatctattcaaaagtcgttaatggctgcggatcaagaaaaagttggaatagaaacagaatacccgcgaaattcaggcccggttgccatgtcctacacgccgaaataaacgaccaaattagtagaaaaataaaaactagctcagatacttacgtcacgtcttgcgcactgatttgaaaaatctcagaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagactcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagtataagagctctatttttacaacaattaccaacaacaacaaacaacaaacaacattacaattacatttacaattaccatggggcgcgcccaatcgatgatttaaatgtgtaagaatttcttatgttacattattacattcaacgttttatcttaattggctcttcatttgattgaaatttgacaattatttcttgtttttttttttgtcacactctttttgggttggggtggccgacgaattgtgggaaggtagaaagaggggaggacttttgttatactccattagtaattactgtttccgtttcaatttatgtgacaatatttcctttttagtcggttccaaaagaaaatgtcagcattataaacaatttaattttgaaattacaattttgccattaataaaatgatttacaaccacaaaagtatctatgagcctgtttgggtgggcttataagcagcttattttaagtggcttataagtcaaaaagtgacantttttgagaagttagaaaatcctaacttctcaaaaagtagcttttaagccacttatgacttataagtccaaaaatttttaagttaccaaacatatattaatgggtttataagcttataagccacttttaagctcacccaaacgggttctatgtctcactttagactacaaattttaaaagtcttcatttatttcttaatctccgtggcgagtnaaactataacacataaagtgaaacggagggaataagatggagtcataaactaatccaaatctatactctctccgttaatttgttttttagtttgatttggtacattaataaaacagatttttcgaaggttataaacacagacagatgtttcccagcgagctagcaaaattccaagatttctgtcgaaaattcgtgtgtttctagctagtacttgatgttatctttaaccttttagtaattttttgtccttttctttctatttttcatcttacaatgaattatgagcaagttccttaagtagcatcacacgtgagatgttttttatgatattgactaaatccaatctttaccattccttaactagtaaaatacaacacatgttaattgatacattgcttaacactgaggttagaaaattttagaaattagttgtccaaatgctttgaaattagaaatctttaatcccttatttttttttaaaatgttttttctcactccaaagaaagagaaactgacatgaaagctcaaaagatcatgaatcttactaactttgtggaactaaatgtacatcagaatgtttctgacatgtgaaaatgaaagctcttaattttcttcttttatttattgagggtttttgcatgctatgcattcaatttgagtactttaaagcacctataaacacttacttacacttgccttggagtttatgttttagtgttttcttcacatcttttttggtcaatttgcaggtatttggatcctaggtgagtctagagagttaattaagacccgggactagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctgg

SEQ ID NO: 1007 - DNA, 3367 bp, Artificial sequence
  vector
ggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacggtatcgataagcttgatatcgaattcctgcagccccaaacacacgctcggacgcatattacacatgttcatacacttaatactcgctgttttgaattgatgttttaggaatatatatgtagagagagcttccttgagtccattcacaggtcgtgatatgattcaattagcttccgactcattcatccaaataccgagtcgccaaaattcaaactagactcgttaaatgaagaatgatgcggtagacaaattggatcattgattctctttgattggactgaagggagctccctctctcttttgtattccaattttcttgattaatctttcctgcacaaaaacatgcttgatccactaagtgacatatatgctgccttcgtatatatagttctggtaaaattaacattttgggtttatctttatttaaggcatcgccatggggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 1008 - DNA, 18691 bp, Artificial sequence
  vector
ggccgcactagtgatatcccgcggccatggcggccgggagcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaaacgttaatgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaatggcaattaccttatccgcaacttctttacctatttccgcccggatccgggcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccgatccaacacttacgtttgcaacgtccaagagcaaatagaccacgaacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgaattaattccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatgtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagccgggatggcgctaagaagctattgccgccgatcttcatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatatcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaaacaagtggcagcaacggattcgcaaacctgtcacgccttttgtgccaaaagccgcgccaggtttgcgatccgctgtgccaggcgttaggcgtcatatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtacttgcgatggcatcggggcaggcacttgctgacctgccaattgttttagtggatgaagctcgtcttccctatgactactccccatccaactacgacatttctccaagcaactacgacaactccataagcaattacgacaatagtccatcaaattacgacaactctgagagcaactacgataatagttcatccaattacgacaatagtcgcaacggaaatcgtaggcttatatatagcgcaaatgggtctcgcactttcgccggctactacgtcattgccaacaatgggacaacgaacttcttttccacatctggcaaaaggatgttctacaccccaaaaggggggcgcggcgtctatggcggcaaagatgggagcttctgcggggcattggtcgtcataaatggccaattttcgcttgccctgacagataacggcctgaagatcatgtatctaagcaactagcctgctctctaataaaatgttaggagcttggctgccatttttggggtgaggccgttcgcggccgaggggcgcagcccctggggggatgggaggcccgcgttagcgggccgggagggttcgagaagggggggcaccccccttcggcgtgcgcggtcacgcgccagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgacatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgattttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgtacggaatgccagcactcccgaggggaaccctgtggttggcatgcacatacaaatggacgaacggataaaccttttcacgcccttttaaatatccgttattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatccaacgcgttgggagctctcccatatcgacctgcaggcggccgctcgacgaattaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatctctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgaggctagcatggatctcgggccccaaataatgattttattttgactgatagtgacctgttcgttgcaacaaattgatgagcaatgcttttttataatgccaactttgtacaaaaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgaccgacagccttccaaatgttcttcgggtgatgctgccaacttagtcgaccgacagccttccaaatgttcttctcaaacggaatcgtcgtatccagcctactcgctattgtcctcaatgccgtattaaatcataaaaagaaataagaaaaagaggtgcgagcctcttttttgtgtgacaaaataaaaacatctacctattcatatacgctagtgtcatagtcctgaaaatcatctgcatcaagaacaatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttcgggtagtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttagtcgactacaggtcactaataccatctaagtagttgattcatagtgactggatatgttgtgttttacagtattatgtagtctgttttttatgcaaaatctaatttaatatattgatatttatatcattttacgtttctcgttcagctttcttgtacaaagttggcattataagaaagcattgcttatcaatttgttgcaacgaacaggtcactatcagtcaaaataaaatcattatttgccatccagctgcagctcctcgaggaattcggtaccccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatacggccggtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatcgcgtggatccggcttactaaaagccagataacagtatgcgtatttgcgcgctgatttttgcggtataagaatatatactgatatgtcgggcccataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcattttatatagtattattttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataagcttggatcctctagagagctgcagctggatggcaaataatgattttattttgactgatagtgacctgttcgttgcaacaaattgataagcaatgctttcttataatgccaactttgtacaagaaagctgaacgagaaacgtaaaatgatataaatatcaatatattaaattagattttgcataaaaaacagactacataatactgtaaaacacaacatatccagtcactatgaatcaactacttagatggtattagtgacctgtagtcgactaagttggcagcatcacccgacgcactttgcgccgaataaatacctgtgacggaagatcacttcgcagaataaataaatcctggtgtccctgttgataccgggaagccctgggccaacttttggcgaaaatgagacgttgatcggcactacccatttcacaactcttatacttttctcttacaagtcgttcggcttcatctggattttcagcctctatacttactaaacgtgataaagtttctgtaatttctactgtatcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttctgttcttgatgcagatgattttcaggactatgacactagcgtatatgaataggtagatgtttttattttgtcacacaaaaaagaggctcgcacctctttttcttatttctttttatgatttaatacggcattgaggacaatagcgagtaggctggatacgacgattccgtttgagaagaacatttggaaggctgtcggtcgactaagttggcagcatcacccgaagaacatttggaaggctgtcggtcgactacaggtcactaataccatctaagtagttgattcatagtgactggatatgttgtgttttacagtattatgtagtctgttttttatgcaaaatctaatttaatatattgatatttatatcattttacgtttctcgttcagcttttttgtacaaagttggcattataaaaaagcattgctcatcaatttgttgcaacgaacaggtcactatcagtcaaaataaaatcattatttggggcccgagatccatgctagctctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaaggccccaggggctagtatctacgacacaccgagcggcgaactaataacgttcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcaggacctgcaggcatgcaagctagcttactagtgatgcatattctatagtgtcacctaaatctgc

SEQ ID NO: 1009 - DNA, 12096 bp, Artificial sequence
  vector
aattcagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcgagctccaccgcggtgggcggccgctctagaactagttaattaaggaattattaccctttgatcctgaatagagcactgccatctgaaacctgttggcctgctttaactttgaggtcctgtatgcttccagaggatggtgctttcacaacgtgctccatcttcattgcctctaggactaatataggttgaccttgatctactttggcttcgttttcgacaaggaccttgactaccaaaccagccatgggggccacaatggttcctggagggtgtgatgatgtttcggagctggttggatctgcggaacccagtggaccctggaacaaaacttcgaggccaccggatgcataatcaggaacgtcataagggtaagaacctgtgcggccgccgctagctcgaaccactttgtacaagaaagctgaacgagaaacgtaaaatgatataaatatcaatatattaaattagattttgcataaaaaacagactacataatactgtaaaacacaacatatccagtcactatggtcgacctgcagactggctgtgtataagggagcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagtccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcacacctctttttgacatacttcgggtatacatatcagtatatattcttataccgcaaaaatcagcgcgcaaatacgcatactgttatctggcttttagtaagccggatcctctagattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgccggatcctaactcaaaatccacacattatacgagccggaagcataaagtgtaaagcctggggtgcctaatgcggccgccatagtgactggatatgttgtgttttacagtattatgtagtctgttttttatgcaaaatctaatttaatatattgatatttatatcattttacgtttctcgttcagcttttttgtacaaacttgtttgatagcttggcgcgcctcgagggggggcccggtacccggggatcctctagagtcgaggtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacctgcaggcacgccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgccccccgggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcaaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacg
